United States Patent
Seth Chhabra et al.

(10) Patent No.: US 12,030,925 B2
(45) Date of Patent: *Jul. 9, 2024

(54) METHODS OF TREATING HEMOPHILIA A

(71) Applicant: BIOVERATIV THERAPEUTICS INC., Waltham, MA (US)

(72) Inventors: Ekta Seth Chhabra, Framingham, MA (US); Alison Innes, Waltham, MA (US); Dan Rudin, Waltham, MA (US); Kara Rice, Waltham, MA (US); Nancy Wong, Waltham, MA (US); Suresh Katragadda, Waltham, MA (US)

(73) Assignee: BIOVERATIV THERAPEUTICS INC., Waltham, MA (US)

(*) Notice: Subject to any disclaimer, the term of this patent is extended or adjusted under 35 U.S.C. 154(b) by 0 days.

This patent is subject to a terminal disclaimer.

(21) Appl. No.: 16/415,893

(22) Filed: May 17, 2019

(65) Prior Publication Data

US 2019/0375822 A1 Dec. 12, 2019

Related U.S. Application Data

(60) Provisional application No. 62/801,576, filed on Feb. 5, 2019, provisional application No. 62/773,785, filed on Nov. 30, 2018, provisional application No. 62/712,880, filed on Jul. 31, 2018, provisional application No. 62/673,670, filed on May 18, 2018.

(51) Int. Cl.
*A61K 38/00* (2006.01)
*A61P 7/04* (2006.01)
*C07K 14/755* (2006.01)

(52) U.S. Cl.
CPC .............. *C07K 14/755* (2013.01); *A61P 7/04* (2018.01); *A61K 38/00* (2013.01); *C07K 2319/30* (2013.01)

(58) Field of Classification Search
CPC ........ A61K 38/36; A61K 38/37; A61K 38/00; A61K 2300/00; A61K 47/64; A61P 7/04; C07K 14/755; C07K 2319/30

See application file for complete search history.

(56) References Cited

U.S. PATENT DOCUMENTS

| | | |
|---|---|---|
| 836,805 A | 11/1906 | Dozier |
| 3,992,518 A | 11/1976 | Chien et al. |
| 4,088,864 A | 5/1978 | Theeuwes et al. |
| 4,179,337 A | 12/1979 | Davis et al. |
| 4,200,098 A | 4/1980 | Ayer et al. |
| 4,200,984 A | 5/1980 | Fink |
| 4,215,051 A | 7/1980 | Palmer et al. |
| 4,235,881 A | 11/1980 | Cort |
| 4,284,444 A | 8/1981 | Bernstein et al. |
| 4,398,908 A | 8/1983 | Siposs |
| 4,435,173 A | 3/1984 | Siposs et al. |
| 4,456,591 A | 6/1984 | Thomas |
| 4,542,025 A | 9/1985 | Tice et al. |
| 4,599,311 A | 7/1986 | Kawasaki |
| 4,683,195 A | 7/1987 | Mullis et al. |
| 4,683,202 A | 7/1987 | Mullis |
| 4,684,479 A | 8/1987 | D'Arrigo |
| 4,704,362 A | 11/1987 | Itakura et al. |
| 4,713,339 A | 12/1987 | Levinson et al. |
| 4,757,006 A | 7/1988 | Toole, Jr. et al. |
| 4,770,999 A | 9/1988 | Kaufman et al. |
| 4,784,950 A | 11/1988 | Hagen et al. |
| 4,800,159 A | 1/1989 | Mullis et al. |
| 4,845,075 A | 7/1989 | Murray et al. |
| 4,861,800 A | 8/1989 | Buyske |
| 4,868,112 A | 9/1989 | Toole, Jr. |
| 4,870,008 A | 9/1989 | Brake |
| 4,882,279 A | 11/1989 | Cregg |
| 4,897,268 A | 1/1990 | Tice et al. |
| 4,931,373 A | 6/1990 | Kawasaki et al. |
| 4,933,185 A | 6/1990 | Wheatley et al. |
| 4,965,188 A | 10/1990 | Mullis et al. |
| 4,965,199 A | 10/1990 | Capon et al. |
| 4,970,300 A | 11/1990 | Fulton et al. |
| 4,976,696 A | 12/1990 | Sanderson et al. |
| 4,988,337 A | 1/1991 | Ito |
| 4,994,371 A | 2/1991 | Davie et al. |
| 5,004,803 A | 4/1991 | Kaufman et al. |
| 5,004,804 A | 4/1991 | Kuo et al. |

(Continued)

FOREIGN PATENT DOCUMENTS

| | | |
|---|---|---|
| AU | 609829 B2 | 5/1991 |
| AU | 2016213822 B2 | 8/2017 |

(Continued)

OTHER PUBLICATIONS

Skotnicki et al. Efficacy, safety and pharmacokinetic profiles of a plasma-derived VWF/FVIII concentrate (VONCENTO®) in subjects with haemophilia A. (SWIFT-HA study). Thrombosis Research 137 (2016) 119-125 (Year: 2016).*

Skotnicki et al. Efficacy, safety and pharmacokinetic profiles of a plasma-derived VWF/FVIII concentrate (VONCENTO®) in subjects with haemophilia A (SWIFT-HA study). 2015. Thrombosis Research vol. 137, Jan. 2016, pp. 119-125 (Year: 2015).*

Shapiro et al. Recombinant factor VIII Fc fusion protein: extended-interval dosing maintains low bleeding rates and correlates with von Willebrand factor levels. 2014. Journal of Thrombosis and Haemostasis, 12: 1788-1800 (Year: 2014).*

Drager et al. Recombinant FVIIIFc-VWF-XTEN Demonstrates Significant Bioavailability Following Subcutaneous Administration in Hemophilia A Mice. Blood (2015) 126 (23): 3492. (Year: 2015).*

(Continued)

*Primary Examiner* — Aradhana Sasan
*Assistant Examiner* — Mercy H Sabila
(74) *Attorney, Agent, or Firm* — LATHROP GPM LLP; James V. DeGiulio, Esq.; James H. Velema, Esq.

(57) ABSTRACT

The present disclosure provides a method of treating hemophilia A in a human subject in need thereof comprising administering to the subject a chimeric polypeptide comprising (i) a factor VIII (FVIII) protein and (ii) a von Willebrand factor (VWF) fragment comprising a D' domain of VWF and a D3 domain of VWF at a dosing interval.

19 Claims, 6 Drawing Sheets

Figure 1:
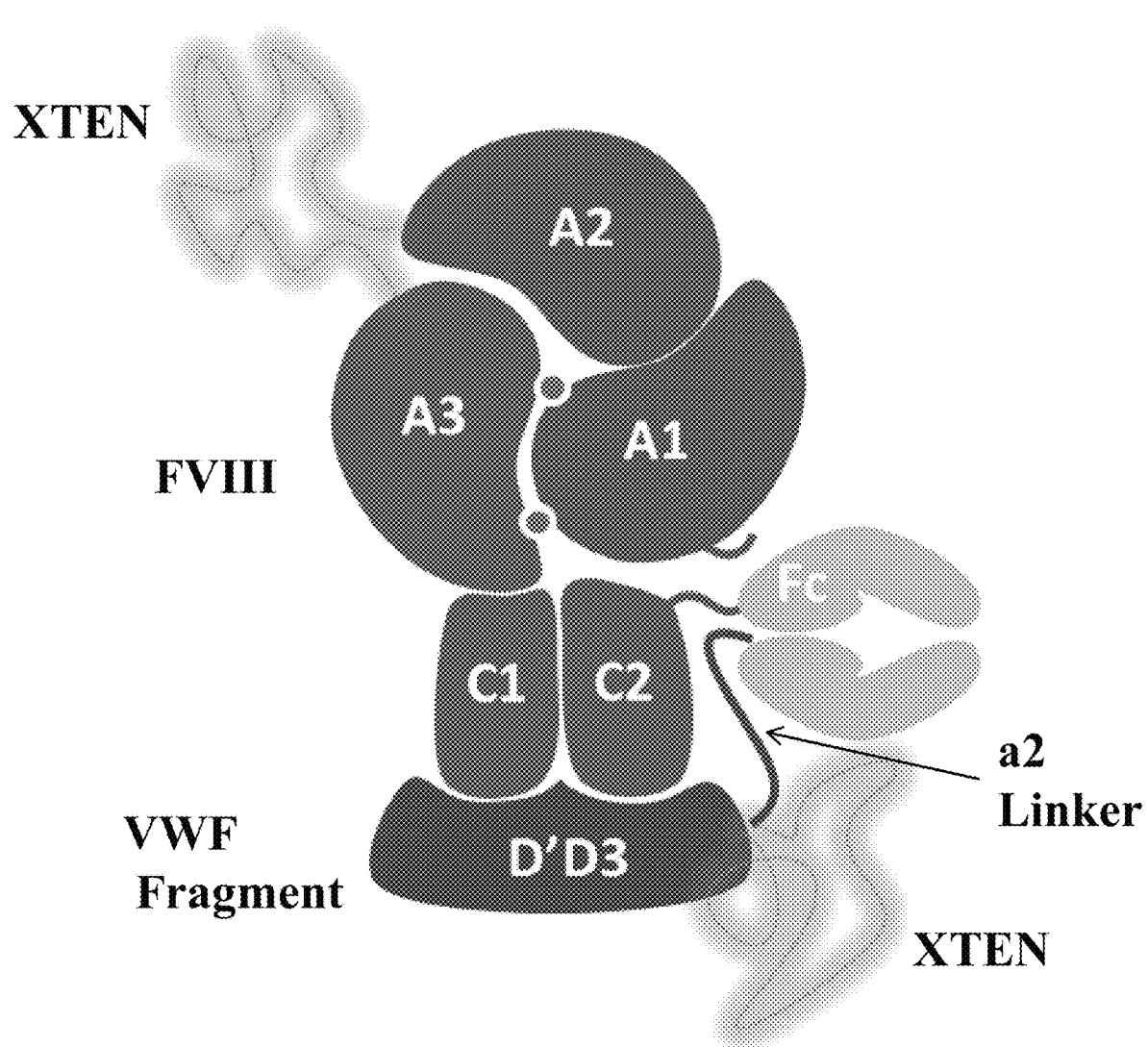

Specification includes a Sequence Listing.

(56) References Cited

U.S. PATENT DOCUMENTS

| | | |
|---|---|---|
| 5,017,378 A | 5/1991 | Turner et al. |
| 5,037,743 A | 8/1991 | Welch et al. |
| 5,089,474 A | 2/1992 | Castro et al. |
| 5,112,950 A | 5/1992 | Meulien et al. |
| 5,171,844 A | 12/1992 | Van Ooyen et al. |
| 5,176,502 A | 1/1993 | Sanderson et al. |
| 5,186,938 A | 2/1993 | Sablotsky et al. |
| 5,198,349 A | 3/1993 | Kaufman |
| 5,215,680 A | 6/1993 | D'Arrigo |
| 5,223,409 A | 6/1993 | Ladner et al. |
| 5,250,421 A | 10/1993 | Kaufman et al. |
| 5,270,176 A | 12/1993 | Dorschug et al. |
| 5,298,022 A | 3/1994 | Bernardi |
| 5,318,540 A | 6/1994 | Athayde et al. |
| 5,364,771 A | 11/1994 | Lollar et al. |
| 5,364,934 A | 11/1994 | Drayna et al. |
| 5,407,609 A | 4/1995 | Tice et al. |
| 5,422,260 A | 6/1995 | Kaufman et al. |
| 5,424,199 A | 6/1995 | Goeddel et al. |
| 5,492,534 A | 2/1996 | Athayde et al. |
| 5,534,617 A | 7/1996 | Cunningham et al. |
| 5,543,502 A | 8/1996 | Nordfang et al. |
| 5,554,730 A | 9/1996 | Woiszwillo et al. |
| 5,573,776 A | 11/1996 | Harrison et al. |
| 5,576,291 A | 11/1996 | Curtis et al. |
| 5,578,709 A | 11/1996 | Woiszwillo |
| 5,595,886 A | 1/1997 | Chapman et al. |
| 5,599,907 A | 2/1997 | Anderson et al. |
| 5,610,278 A | 3/1997 | Nordfang et al. |
| 5,643,575 A | 7/1997 | Martinez et al. |
| 5,648,260 A | 7/1997 | Winter et al. |
| 5,658,570 A | 8/1997 | Newman et al. |
| 5,660,848 A | 8/1997 | Moo-Young |
| 5,693,499 A | 12/1997 | Yonemura et al. |
| 5,712,122 A | 1/1998 | Boime et al. |
| 5,739,277 A | 4/1998 | Presta et al. |
| 5,756,115 A | 5/1998 | Moo-Young et al. |
| 5,789,203 A | 8/1998 | Chapman et al. |
| 5,833,982 A | 11/1998 | Berkner et al. |
| 5,834,250 A | 11/1998 | Wells et al. |
| 5,837,679 A | 11/1998 | Wolf et al. |
| 5,846,951 A | 12/1998 | Gregoriadis |
| 5,859,204 A | 1/1999 | Lollar |
| 5,869,046 A | 2/1999 | Presta et al. |
| 5,874,104 A | 2/1999 | Adler-Moore et al. |
| 5,916,588 A | 6/1999 | Popescu et al. |
| 5,919,766 A | 7/1999 | Osterberg et al. |
| 5,942,252 A | 8/1999 | Tice et al. |
| 5,965,156 A | 10/1999 | Proffitt et al. |
| 5,972,885 A | 10/1999 | Spira et al. |
| 5,981,216 A | 11/1999 | Kenten et al. |
| 5,981,719 A | 11/1999 | Woiszwillo et al. |
| 6,005,082 A | 12/1999 | Smeds |
| 6,024,983 A | 2/2000 | Tice et al. |
| 6,030,613 A | 2/2000 | Blumberg et al. |
| 6,037,452 A | 3/2000 | Hitoshi |
| 6,043,094 A | 3/2000 | Martin et al. |
| 6,048,720 A | 4/2000 | Dalborg et al. |
| 6,056,973 A | 5/2000 | Allen et al. |
| 6,060,447 A | 5/2000 | Chapman et al. |
| 6,086,875 A | 7/2000 | Blumberg et al. |
| 6,090,925 A | 7/2000 | Woiszwillo et al. |
| 6,096,871 A | 8/2000 | Presta et al. |
| 6,110,498 A | 8/2000 | Rudnic et al. |
| 6,121,022 A | 9/2000 | Presta et al. |
| 6,126,966 A | 10/2000 | Abra et al. |
| 6,159,730 A | 12/2000 | Reff |
| 6,183,770 B1 | 2/2001 | Muchin et al. |
| 6,194,551 B1 | 2/2001 | Idusogie et al. |
| 6,228,620 B1 | 5/2001 | Chapman et al. |
| 6,242,195 B1 | 6/2001 | Idusogie et al. |
| 6,251,632 B1 | 6/2001 | Lillicrap et al. |
| 6,254,573 B1 | 7/2001 | Haim et al. |
| 6,268,053 B1 | 7/2001 | Woiszwillo et al. |
| 6,277,375 B1 | 8/2001 | Ward |
| 6,284,276 B1 | 9/2001 | Rudnic et al. |
| 6,294,170 B1 | 9/2001 | Boone et al. |
| 6,294,191 B1 | 9/2001 | Meers et al. |
| 6,294,201 B1 | 9/2001 | Kettelhoit et al. |
| 6,303,148 B1 | 10/2001 | Hennink et al. |
| 6,309,370 B1 | 10/2001 | Haim et al. |
| 6,310,183 B1 | 10/2001 | Johannessen et al. |
| 6,316,024 B1 | 11/2001 | Allen et al. |
| 6,316,226 B1 | 11/2001 | Van Ooyen et al. |
| 6,329,186 B1 | 12/2001 | Nielsen et al. |
| 6,346,513 B1 | 2/2002 | Van Ooyen et al. |
| 6,352,716 B1 | 3/2002 | Janoff et al. |
| 6,352,721 B1 | 3/2002 | Faour |
| 6,358,703 B1 | 3/2002 | Cho et al. |
| 6,361,796 B1 | 3/2002 | Rudnic et al. |
| 6,376,463 B1 | 4/2002 | Lollar |
| 6,395,302 B1 | 5/2002 | Hennink et al. |
| 6,406,632 B1 | 6/2002 | Safir et al. |
| 6,406,713 B1 | 6/2002 | Janoff et al. |
| 6,413,777 B1 | 7/2002 | Reff et al. |
| 6,458,387 B1 | 10/2002 | Scott et al. |
| 6,458,563 B1 | 10/2002 | Lollar |
| 6,485,726 B1 | 11/2002 | Blumberg et al. |
| 6,514,532 B2 | 2/2003 | Rudnic et al. |
| 6,517,859 B1 | 2/2003 | Tice et al. |
| 6,528,624 B1 | 3/2003 | Idusogie et al. |
| 6,530,648 B2 | 3/2003 | Leu et al. |
| 6,534,090 B2 | 3/2003 | Puthli et al. |
| 6,538,124 B1 | 3/2003 | Idusogie et al. |
| 6,572,585 B2 | 6/2003 | Choi |
| 6,669,961 B2 | 12/2003 | Kim et al. |
| 6,686,179 B2 | 2/2004 | Fleer et al. |
| 6,696,245 B2 | 2/2004 | Winter et al. |
| 6,713,086 B2 | 3/2004 | Qiu et al. |
| 6,715,485 B1 | 4/2004 | Djupesland |
| 6,733,753 B2 | 5/2004 | Boone et al. |
| 6,737,056 B1 | 5/2004 | Presta |
| 6,743,211 B1 | 6/2004 | Prausnitz et al. |
| 6,759,057 B1 | 7/2004 | Weiner et al. |
| 6,770,744 B2 | 8/2004 | Lollar |
| 6,814,979 B2 | 11/2004 | Rudnic et al. |
| 6,818,439 B1 | 11/2004 | Jolly et al. |
| 6,821,505 B2 | 11/2004 | Ward |
| 6,833,352 B2 | 12/2004 | Johannessen et al. |
| 6,838,093 B2 | 1/2005 | Flanner et al. |
| 6,887,852 B1 | 5/2005 | Paik et al. |
| 6,890,918 B2 | 5/2005 | Burnside et al. |
| 6,905,688 B2 | 6/2005 | Rosen et al. |
| 6,911,323 B2 | 6/2005 | Persson et al. |
| 6,919,311 B2 | 7/2005 | Lenting et al. |
| 6,945,952 B2 | 9/2005 | Kwon |
| 6,960,657 B2 | 11/2005 | Persson et al. |
| 6,998,253 B1 | 2/2006 | Presta et al. |
| 7,026,524 B2 | 4/2006 | Persson et al. |
| 7,041,635 B2 | 5/2006 | Kim et al. |
| 7,045,318 B2 | 5/2006 | Balance |
| 7,083,784 B2 | 8/2006 | Dall'acqua et al. |
| 7,091,321 B2 | 8/2006 | Gillies et al. |
| 7,125,841 B2 | 10/2006 | Sheehan |
| 7,138,505 B1 | 11/2006 | Kuo et al. |
| 7,176,288 B2 | 2/2007 | Persson et al. |
| 7,199,223 B2 | 4/2007 | Bossard et al. |
| 7,211,559 B2 | 5/2007 | Saenko et al. |
| 7,276,475 B2 | 10/2007 | Defrees et al. |
| 7,276,593 B2 | 10/2007 | Vernet et al. |
| 7,294,513 B2 | 11/2007 | Wyatt |
| 7,317,091 B2 | 1/2008 | Lazar et al. |
| 7,329,640 B2 | 2/2008 | Vlasuk |
| 7,348,004 B2 | 3/2008 | Peters et al. |
| 7,381,408 B2 | 6/2008 | Mezo et al. |
| 7,404,956 B2 | 7/2008 | Peters et al. |
| 7,413,537 B2 | 8/2008 | Ladner et al. |
| 7,414,022 B2 | 8/2008 | Pedersen et al. |
| 7,442,778 B2 | 10/2008 | Gegg et al. |
| 7,452,967 B2 | 11/2008 | Bertin |
| 7,507,406 B2 | 3/2009 | Gillies et al. |
| 7,511,024 B2 | 3/2009 | Pedersen et al. |
| 7,514,257 B2 | 4/2009 | Lee et al. |
| 7,528,242 B2 | 5/2009 | Anderson et al. |

(56) References Cited

U.S. PATENT DOCUMENTS

| | | |
|---|---|---|
| 7,560,107 B2 | 7/2009 | Lollar |
| 7,566,701 B2 | 7/2009 | Diener et al. |
| 7,592,010 B2 | 9/2009 | Rosen et al. |
| 7,620,601 B2 | 11/2009 | Miyawaki et al. |
| 7,632,921 B2 | 12/2009 | Pan et al. |
| 7,645,860 B2 | 1/2010 | Turecek et al. |
| 7,683,158 B2 | 3/2010 | Siekmann et al. |
| 7,700,733 B2 | 4/2010 | Haaning et al. |
| 7,700,734 B2 | 4/2010 | Lin et al. |
| 7,786,070 B2 | 8/2010 | Johannessen et al. |
| 7,790,415 B2 | 9/2010 | Gillies et al. |
| 7,820,162 B2 | 10/2010 | Mezo et al. |
| 7,846,445 B2 | 12/2010 | Schellenberger et al. |
| 7,846,455 B2 | 12/2010 | Collins et al. |
| 7,855,279 B2 | 12/2010 | Schellenberger et al. |
| 7,862,820 B2 | 1/2011 | Peters et al. |
| 7,884,075 B2 | 2/2011 | Scheiflinger et al. |
| 7,939,632 B2 | 5/2011 | Metzner et al. |
| 8,329,182 B2 | 12/2012 | Peters et al. |
| 8,357,779 B2 | 1/2013 | Scheiflinger et al. |
| 8,367,805 B2 | 2/2013 | Chamberlain et al. |
| 8,492,530 B2 | 7/2013 | Schellenberger et al. |
| 8,563,521 B2 | 10/2013 | Skerra et al. |
| 8,575,104 B2 | 11/2013 | Weimer et al. |
| 8,673,860 B2 | 3/2014 | Schellenberger et al. |
| 8,680,050 B2 | 3/2014 | Schellenberger et al. |
| 8,703,717 B2 | 4/2014 | Schellenberger et al. |
| 8,716,448 B2 | 5/2014 | Schellenberger et al. |
| 8,754,194 B2 | 6/2014 | Schulte et al. |
| 8,835,388 B2 | 9/2014 | Scheiflinger et al. |
| 8,933,197 B2 | 1/2015 | Stemmer et al. |
| 9,050,318 B2 | 6/2015 | Dumont et al. |
| 9,107,902 B2 | 8/2015 | Kronthaler |
| 9,168,312 B2 | 10/2015 | Schellenberger et al. |
| 9,241,978 B2 | 1/2016 | Dumont et al. |
| 9,376,672 B2 | 6/2016 | Schellenberger et al. |
| 9,458,223 B2 | 10/2016 | Schulte et al. |
| 9,878,017 B2 | 1/2018 | Metzner et al. |
| 9,956,269 B2 | 5/2018 | Horn et al. |
| 9,958,572 B2 | 5/2018 | Chang et al. |
| 10,138,291 B2 | 11/2018 | Chhabra et al. |
| 10,370,430 B2 | 8/2019 | Kulman et al. |
| 10,421,798 B2 | 9/2019 | Schellenberger et al. |
| 10,537,616 B2 | 1/2020 | Horn et al. |
| 10,786,554 B2 | 9/2020 | Maloney et al. |
| 10,881,717 B2 | 1/2021 | Horn et al. |
| 11,091,534 B2 | 8/2021 | Chhabra et al. |
| 11,192,936 B2 | 12/2021 | Chhabra et al. |
| 11,266,720 B2 | 3/2022 | Dumont et al. |
| 11,370,827 B2 | 6/2022 | Chaabra et al. |
| 2002/0019036 A1 | 2/2002 | Schwarz et al. |
| 2002/0042079 A1 | 4/2002 | Simon et al. |
| 2002/0150881 A1 | 10/2002 | Ladner et al. |
| 2003/0049689 A1 | 3/2003 | Edwards et al. |
| 2003/0065787 A1 | 4/2003 | Osafune et al. |
| 2003/0069395 A1 | 4/2003 | Sato et al. |
| 2003/0143697 A1 | 7/2003 | Stahl et al. |
| 2003/0181381 A1 | 9/2003 | Himmelspach et al. |
| 2003/0199444 A1 | 10/2003 | Knudsen et al. |
| 2003/0228309 A1 | 12/2003 | Salcedo et al. |
| 2003/0235536 A1 | 12/2003 | Blumberg et al. |
| 2004/0029207 A1 | 2/2004 | Marnett et al. |
| 2004/0043446 A1 | 3/2004 | Defrees et al. |
| 2004/0101740 A1 | 5/2004 | Sanders |
| 2004/0106118 A1 | 6/2004 | Kolmar et al. |
| 2004/0147436 A1 | 7/2004 | Kim et al. |
| 2004/0192599 A1 | 9/2004 | Schuh et al. |
| 2004/0203107 A1 | 10/2004 | Murray |
| 2004/0259780 A1 | 12/2004 | Glasebrook et al. |
| 2005/0042721 A1 | 2/2005 | Fang et al. |
| 2005/0048512 A1 | 3/2005 | Kolkman et al. |
| 2005/0100990 A1 | 5/2005 | Saenko et al. |
| 2005/0118136 A1 | 6/2005 | Leung et al. |
| 2005/0123997 A1 | 6/2005 | Lollar |
| 2005/0147618 A1 | 7/2005 | Rivera |
| 2005/0260194 A1 | 11/2005 | Peters et al. |
| 2005/0260605 A1 | 11/2005 | Punnonen et al. |
| 2005/0266533 A1 | 12/2005 | Ballance et al. |
| 2005/0287153 A1 | 12/2005 | Dennis |
| 2006/0026719 A1 | 2/2006 | Kieliszewski et al. |
| 2006/0040856 A1 | 2/2006 | Defrees et al. |
| 2006/0074199 A1 | 4/2006 | Hirata et al. |
| 2006/0084113 A1 | 4/2006 | Ladner et al. |
| 2006/0115876 A1 | 6/2006 | Pan et al. |
| 2006/0122376 A1 | 6/2006 | Chapman et al. |
| 2006/0159675 A1 | 7/2006 | Jiao et al. |
| 2006/0160948 A1 | 7/2006 | Scheiflinger et al. |
| 2006/0205036 A1 | 9/2006 | Ostergaard et al. |
| 2006/0211621 A1 | 9/2006 | Knudsen et al. |
| 2006/0287220 A1 | 12/2006 | Li et al. |
| 2006/0293232 A1 | 12/2006 | Levy et al. |
| 2006/0293238 A1 | 12/2006 | Kaufman et al. |
| 2007/0021494 A1 | 1/2007 | Taveras et al. |
| 2007/0048282 A1 | 3/2007 | Rosen et al. |
| 2007/0161087 A1 | 7/2007 | Glaesner et al. |
| 2007/0191272 A1 | 8/2007 | Stemmer et al. |
| 2007/0191597 A1 | 8/2007 | Jain et al. |
| 2007/0203058 A1 | 8/2007 | Lau et al. |
| 2007/0212703 A1 | 9/2007 | Stemmer et al. |
| 2007/0231329 A1 | 10/2007 | Lazar et al. |
| 2007/0237765 A1 | 10/2007 | Lazar et al. |
| 2007/0237766 A1 | 10/2007 | Lazar et al. |
| 2007/0237767 A1 | 10/2007 | Lazar et al. |
| 2007/0243188 A1 | 10/2007 | Lazar et al. |
| 2007/0244301 A1 | 10/2007 | Siekmann et al. |
| 2007/0248603 A1 | 10/2007 | Lazar et al. |
| 2007/0286859 A1 | 12/2007 | Lazar et al. |
| 2008/0004206 A1 | 1/2008 | Rosen et al. |
| 2008/0033413 A1 | 2/2008 | Inochkin et al. |
| 2008/0039341 A1 | 2/2008 | Schellenberger et al. |
| 2008/0057056 A1 | 3/2008 | Lazar et al. |
| 2008/0146782 A1 | 6/2008 | Defrees et al. |
| 2008/0153751 A1 | 6/2008 | Rosen et al. |
| 2008/0161243 A1 | 7/2008 | Rosen et al. |
| 2008/0167219 A1 | 7/2008 | Lin et al. |
| 2008/0167238 A1 | 7/2008 | Rosen et al. |
| 2008/0176288 A1 | 7/2008 | Leung et al. |
| 2008/0193441 A1 | 8/2008 | Trown et al. |
| 2008/0194481 A1 | 8/2008 | Rosen et al. |
| 2008/0214462 A1 | 9/2008 | Dockal et al. |
| 2008/0227691 A1 | 9/2008 | Ostergaard et al. |
| 2008/0233100 A1 | 9/2008 | Chen et al. |
| 2008/0234193 A1 | 9/2008 | Bossard et al. |
| 2008/0255040 A1 | 10/2008 | Defrees |
| 2008/0260755 A1 | 10/2008 | Metzner et al. |
| 2008/0261877 A1 | 10/2008 | Ballance et al. |
| 2008/0269125 A1 | 10/2008 | Ballance et al. |
| 2008/0286808 A1 | 11/2008 | Schellenberger et al. |
| 2008/0312157 A1 | 12/2008 | Levy et al. |
| 2009/0011992 A1 | 1/2009 | Olsen et al. |
| 2009/0042787 A1 | 2/2009 | Metzner et al. |
| 2009/0058322 A1 | 3/2009 | Toma et al. |
| 2009/0060862 A1 | 3/2009 | Chang et al. |
| 2009/0087411 A1 | 4/2009 | Fares et al. |
| 2009/0092582 A1 | 4/2009 | Bogin et al. |
| 2009/0099031 A1 | 4/2009 | Stemmer et al. |
| 2009/0117104 A1 | 5/2009 | Baker et al. |
| 2009/0118185 A1 | 5/2009 | Fay et al. |
| 2009/0169553 A1 | 7/2009 | Day |
| 2009/0192076 A1 | 7/2009 | Matthiessen et al. |
| 2009/0247459 A1 | 10/2009 | Schwarz et al. |
| 2009/0250598 A1 | 10/2009 | Hamada et al. |
| 2009/0263380 A1 | 10/2009 | Gilles et al. |
| 2010/0022445 A1 | 1/2010 | Scheiflinger et al. |
| 2010/0081187 A1 | 4/2010 | Griffith et al. |
| 2010/0081615 A1 | 4/2010 | Pan et al. |
| 2010/0120664 A1 | 5/2010 | Schulte et al. |
| 2010/0130427 A1 | 5/2010 | Bossard et al. |
| 2010/0143326 A1 | 6/2010 | Rischel et al. |
| 2010/0189682 A1 | 7/2010 | Schellenberger et al. |
| 2010/0239554 A1 | 9/2010 | Schellenberger et al. |
| 2010/0260706 A1 | 10/2010 | Bogin et al. |
| 2010/0285021 A1 | 11/2010 | Jacquemin et al. |
| 2010/0292130 A1 | 11/2010 | Skerra et al. |

(56) References Cited

U.S. PATENT DOCUMENTS

| | | |
|---|---|---|
| 2010/0183556 A1 | 12/2010 | Choi et al. |
| 2010/0323956 A1 | 12/2010 | Schellenberger et al. |
| 2011/0046060 A1 | 2/2011 | Schellenberger et al. |
| 2011/0046061 A1 | 2/2011 | Schellenberger et al. |
| 2011/0069164 A1 | 3/2011 | Satoshi et al. |
| 2011/0077199 A1 | 3/2011 | Schellenberger et al. |
| 2011/0124656 A1 | 5/2011 | Hauser et al. |
| 2011/0151433 A1 | 6/2011 | Schellenberger et al. |
| 2011/0172146 A1 | 7/2011 | Schellenberger et al. |
| 2011/0183907 A1 | 7/2011 | Weimer et al. |
| 2011/0263595 A1 | 10/2011 | Zhang et al. |
| 2011/0286988 A1 | 11/2011 | Jiang et al. |
| 2011/0287517 A1 | 11/2011 | Steward et al. |
| 2011/0288005 A1 | 11/2011 | Silverman et al. |
| 2011/0312881 A1 | 12/2011 | Silverman et al. |
| 2012/0065077 A1 | 3/2012 | Astermark et al. |
| 2012/0121706 A1 | 5/2012 | Kuliopulos et al. |
| 2012/0142593 A1 | 6/2012 | Zhao et al. |
| 2012/0178691 A1 | 7/2012 | Schellenberger et al. |
| 2012/0220011 A1 | 8/2012 | Schellenberger et al. |
| 2012/0230947 A1 | 9/2012 | Schellenberger et al. |
| 2012/0263701 A1 | 10/2012 | Schellenberger et al. |
| 2012/0263703 A1 | 10/2012 | Schellenberger et al. |
| 2012/0289468 A1 | 11/2012 | Barnett |
| 2012/0308641 A1 | 12/2012 | Arruda et al. |
| 2013/0001799 A1 | 1/2013 | Chang et al. |
| 2013/0017997 A1 | 1/2013 | Schellenberger et al. |
| 2013/0039884 A1 | 2/2013 | Bogin et al. |
| 2013/0108629 A1 | 5/2013 | Dumont et al. |
| 2013/0165389 A1 | 6/2013 | Schellenberger et al. |
| 2013/0171138 A1 | 7/2013 | Peters et al. |
| 2013/0172274 A1 | 7/2013 | Chilkoti |
| 2013/0183280 A1 | 7/2013 | Oestergaard et al. |
| 2013/0274194 A1 | 10/2013 | Dumont et al. |
| 2014/0018297 A1 | 1/2014 | Bolt et al. |
| 2014/0050693 A1 | 2/2014 | Skerra et al. |
| 2014/0072561 A1 | 3/2014 | Weimer et al. |
| 2014/0186327 A1 | 7/2014 | Schellenberger et al. |
| 2014/0273096 A1 | 9/2014 | Schulte et al. |
| 2014/0294821 A1 | 10/2014 | Dumont et al. |
| 2014/0301974 A1 | 10/2014 | Schellenberger et al. |
| 2014/0308280 A1 | 10/2014 | Maloney et al. |
| 2014/0328819 A1 | 11/2014 | Schellenberger et al. |
| 2014/0356326 A1 | 12/2014 | Schellenberger et al. |
| 2014/0370035 A1 | 12/2014 | Jiang et al. |
| 2014/0371136 A1 | 12/2014 | Schellenberger et al. |
| 2015/0023959 A1 | 1/2015 | Chhabra et al. |
| 2015/0038421 A1 | 2/2015 | Schellenberger et al. |
| 2015/0158929 A1 | 6/2015 | Schellenberger et al. |
| 2015/0175503 A1 | 6/2015 | Marks et al. |
| 2015/0259431 A1 | 9/2015 | Stemmer et al. |
| 2015/0266943 A1 | 9/2015 | Chhabra et al. |
| 2015/0328819 A1 | 11/2015 | Tom et al. |
| 2015/0344862 A1 | 12/2015 | Schellenberger et al. |
| 2016/0115467 A1 | 4/2016 | Salas |
| 2016/0199454 A1 | 7/2016 | Liu et al. |
| 2016/0199455 A1 | 7/2016 | Dumont et al. |
| 2016/0200794 A1 | 7/2016 | Metzner et al. |
| 2016/0229903 A1 | 8/2016 | Chhabra et al. |
| 2016/0251408 A1 | 9/2016 | Chhabra et al. |
| 2016/0306945 A1 | 10/2016 | Jiang |
| 2016/0355568 A1 | 12/2016 | Kulman et al. |
| 2016/0376344 A1 | 12/2016 | Schellenberger et al. |
| 2017/0073393 A1 | 3/2017 | Chhabra et al. |
| 2017/0152300 A1 | 6/2017 | Wilson et al. |
| 2017/0209546 A1 | 7/2017 | Schmidbauer et al. |
| 2018/0051067 A1 | 2/2018 | Moses et al. |
| 2018/0161402 A1 | 6/2018 | Schulte et al. |
| 2018/0185455 A1 | 7/2018 | Kannicht et al. |
| 2019/0169267 A1 | 6/2019 | Chhabra et al. |
| 2019/0262429 A1 | 8/2019 | Dumont et al. |
| 2019/0315835 A1 | 10/2019 | Schellenberger et al. |
| 2019/0375822 A1 | 12/2019 | Chhabra et al. |
| 2020/0087379 A1 | 3/2020 | Schellenberger et al. |
| 2020/0095567 A1 | 3/2020 | Metzner et al. |
| 2022/0010347 A1 | 1/2022 | Strack-Logue et al. |
| 2022/0056108 A1 | 2/2022 | Chhabra et al. |
| 2022/0106383 A1 | 4/2022 | Chhabra et al. |
| 2022/0265780 A1 | 8/2022 | Dumont et al. |
| 2022/0275057 A1 | 9/2022 | Chhabra et al. |
| 2023/0011438 A1 | 1/2023 | Chhabra et al. |
| 2023/0019286 A1 | 1/2023 | Schellenberger et al. |
| 2023/0322900 A1 | 10/2023 | Schellenberger et al. |
| 2024/0083875 A1 | 3/2024 | Chhabra et al. |

FOREIGN PATENT DOCUMENTS

| | | |
|---|---|---|
| BR | 112015000267 A2 | 3/2018 |
| CA | 2728012 A1 | 12/2009 |
| CA | 2780542 A1 | 5/2011 |
| CA | 2804280 A1 | 1/2012 |
| CL | 2011001856 A1 | 3/2011 |
| CN | 1761684 A | 4/2006 |
| CN | 1863556 A | 11/2006 |
| CN | 1871252 A | 11/2006 |
| CN | 101190945 A | 6/2008 |
| CN | 101743309 A | 6/2010 |
| CN | 102076855 A | 5/2011 |
| CN | 102348715 A | 2/2012 |
| CN | 102648212 A | 8/2012 |
| CN | 102741422 A | 10/2012 |
| CN | 103796670 A | 5/2014 |
| CN | 104271150 A | 1/2015 |
| CN | 104411716 A | 3/2015 |
| CN | 104487452 A | 4/2015 |
| CN | 104661674 A | 5/2015 |
| CN | 106456718 A | 2/2017 |
| EA | 200501756 A1 | 8/2006 |
| EA | 201590198 A1 | 6/2015 |
| EA | 201792485 A2 | 8/2018 |
| EP | 0 036 776 A3 | 10/1982 |
| EP | 0 154 316 A2 | 9/1985 |
| EP | 0 184 438 A3 | 1/1988 |
| EP | 0 272 277 A1 | 6/1988 |
| EP | 0 244 234 A3 | 10/1988 |
| EP | 0 295 597 A2 | 12/1988 |
| EP | 0 238 023 A3 | 2/1989 |
| EP | 0 401 384 A1 | 12/1990 |
| EP | 0 272 277 B1 | 9/1993 |
| EP | 1444986 A1 | 8/2004 |
| EP | 1 203 014 B1 | 10/2004 |
| EP | 0 506 757 B2 | 10/2005 |
| EP | 1 252 192 B1 | 8/2006 |
| EP | 1935430 A1 | 6/2008 |
| EP | 2 256 135 A1 | 12/2010 |
| EP | 2 173 890 B1 | 3/2011 |
| EP | 2 371 856 A2 | 10/2011 |
| EP | 2506868 A2 | 10/2012 |
| EP | 2 032 607 B1 | 1/2014 |
| EP | 2 796 145 A1 | 10/2014 |
| EP | 2804623 A1 | 11/2014 |
| EP | 2 814 840 A1 | 12/2014 |
| EP | 2882450 A2 | 6/2015 |
| EP | 3013358 A1 | 5/2016 |
| EP | 3091997 A1 | 11/2016 |
| EP | 3326643 A1 | 5/2018 |
| EP | 3505179 A1 | 7/2019 |
| EP | 3548066 A1 | 10/2019 |
| EP | 3 564 260 A1 | 11/2019 |
| EP | 3674410 A1 | 7/2020 |
| EP | 3793588 A1 | 3/2021 |
| JP | 2006-518985 A | 8/2006 |
| JP | 2007-500744 A | 1/2007 |
| JP | 2008-508871 A | 3/2008 |
| JP | 2008-520208 A | 6/2008 |
| JP | 2008-524117 A | 7/2008 |
| JP | 2008-525491 A | 7/2008 |
| JP | 2009-505964 A | 2/2009 |
| JP | 2009-534392 A | 9/2009 |
| JP | 2010-512768 A | 4/2010 |
| JP | 2010-531135 A | 9/2010 |
| JP | 2011-503101 A | 1/2011 |
| JP | 2011-519898 A | 7/2011 |
| JP | 2011-525363 A | 9/2011 |

(56) References Cited

FOREIGN PATENT DOCUMENTS

| | | |
|---|---|---|
| JP | 2011-526151 A | 10/2011 |
| JP | 2011-528562 A | 11/2011 |
| JP | 2013-510581 A | 3/2013 |
| JP | 2013-512678 A | 4/2013 |
| JP | 2013-525363 A | 6/2013 |
| JP | 2013-534427 A | 9/2013 |
| JP | 2015-527882 A | 9/2015 |
| JP | 2016-519670 A | 7/2016 |
| JP | 2016523919 A | 8/2016 |
| JP | 60-62459 B2 | 12/2016 |
| JP | 2017-503509 A | 2/2017 |
| JP | 63-85410 B2 | 8/2018 |
| JP | 2020-115424 A | 7/2020 |
| TW | 201605889 A | 2/2016 |
| WO | WO 1987/004187 A1 | 7/1987 |
| WO | WO 1988/000831 A1 | 2/1988 |
| WO | WO 1988/003558 A1 | 5/1988 |
| WO | WO 1988/007089 A1 | 9/1988 |
| WO | WO 1988/007220 A1 | 9/1988 |
| WO | WO 1988/008035 A1 | 10/1988 |
| WO | WO 1989/009051 A1 | 10/1989 |
| WO | WO 1991/009122 A1 | 6/1991 |
| WO | WO 1992/010576 A1 | 6/1992 |
| WO | WO 1992/016221 A1 | 10/1992 |
| WO | WO 1993/020093 A1 | 10/1993 |
| WO | WO 1994/011503 A2 | 5/1994 |
| WO | WO 1995/034326 A1 | 12/1995 |
| WO | WO 1996/014339 A1 | 5/1996 |
| WO | WO 1997/033552 A1 | 9/1997 |
| WO | WO 1998/005787 A1 | 2/1998 |
| WO | WO 1998/022577 A1 | 5/1998 |
| WO | WO 1998/023289 A1 | 6/1998 |
| WO | WO 1998/052976 A1 | 11/1998 |
| WO | WO 1999/041383 A1 | 8/1999 |
| WO | WO 1999/049901 A1 | 10/1999 |
| WO | WO 1999051642 A1 | 10/1999 |
| WO | WO 1999058572 A1 | 11/1999 |
| WO | WO 2000/003317 A1 | 1/2000 |
| WO | WO 2000/009560 A2 | 2/2000 |
| WO | WO 2000/032767 A1 | 6/2000 |
| WO | WO 2000/042072 A2 | 7/2000 |
| WO | WO 2001/007072 A1 | 2/2001 |
| WO | WO 2001087922 A2 | 11/2001 |
| WO | WO 2015/021423 A2 | 2/2002 |
| WO | WO 2002/044215 A2 | 6/2002 |
| WO | WO 2002/060919 A2 | 8/2002 |
| WO | WO 2002/077036 A2 | 10/2002 |
| WO | WO 2002/079232 A2 | 10/2002 |
| WO | WO 2003/020764 A2 | 3/2003 |
| WO | WO 2003/074569 A2 | 9/2003 |
| WO | WO 2003/077834 A2 | 9/2003 |
| WO | WO 2004/016750 A2 | 2/2004 |
| WO | WO 2004/035752 A2 | 4/2004 |
| WO | WO 2004029207 A2 | 4/2004 |
| WO | WO 2004/044859 A1 | 5/2004 |
| WO | WO 2004/063351 A2 | 7/2004 |
| WO | WO 2004067566 A1 | 8/2004 |
| WO | WO 2004/074455 A2 | 9/2004 |
| WO | WO 2004/076484 A1 | 10/2004 |
| WO | WO 2004/099249 A2 | 11/2004 |
| WO | WO 2004/101739 A2 | 11/2004 |
| WO | WO 2004/101740 A2 | 11/2004 |
| WO | WO 2005/001025 A2 | 1/2005 |
| WO | WO 2005/016455 A2 | 2/2005 |
| WO | WO 2005/025499 A2 | 3/2005 |
| WO | WO 2005/040217 A2 | 5/2005 |
| WO | WO 2005/047327 A2 | 5/2005 |
| WO | WO 2005/069845 A2 | 8/2005 |
| WO | WO 2005/070963 A1 | 8/2005 |
| WO | WO 2005/077981 A2 | 8/2005 |
| WO | WO 2005/092925 A2 | 10/2005 |
| WO | WO 2005/123780 A2 | 12/2005 |
| WO | WO 2006/015879 A1 | 2/2006 |
| WO | WO 2006/019447 A1 | 2/2006 |
| WO | WO 2006/047350 A2 | 5/2006 |
| WO | WO 2006/053299 A2 | 5/2006 |
| WO | WO 2006/074199 A1 | 7/2006 |
| WO | WO 2006071801 A2 | 7/2006 |
| WO | WO 2006/085967 A2 | 8/2006 |
| WO | WO 2006/127040 A2 | 11/2006 |
| WO | WO 2006/081249 A3 | 2/2007 |
| WO | WO 2007/015107 A2 | 2/2007 |
| WO | WO 2007/021494 A2 | 2/2007 |
| WO | WO 2007/073486 A2 | 6/2007 |
| WO | WO 2007/090584 A1 | 8/2007 |
| WO | WO 2007/103455 A2 | 9/2007 |
| WO | WO 2007103515 A2 | 9/2007 |
| WO | WO 2007/124090 A2 | 11/2007 |
| WO | WO 2007/149406 A2 | 12/2007 |
| WO | WO 2007144173 A1 | 12/2007 |
| WO | WO 2008/033413 A2 | 3/2008 |
| WO | WO 2008/049931 A1 | 5/2008 |
| WO | WO 2008057683 A2 | 5/2008 |
| WO | WO 2008077616 A1 | 7/2008 |
| WO | WO 2008/118507 A2 | 10/2008 |
| WO | WO 2008/151258 A2 | 12/2008 |
| WO | WO 2008/155134 A1 | 12/2008 |
| WO | WO 2009023270 A2 | 2/2009 |
| WO | WO 2009/051717 A2 | 4/2009 |
| WO | WO 2009/023270 A3 | 5/2009 |
| WO | WO 2009/058322 A1 | 5/2009 |
| WO | WO 2009062100 A1 | 5/2009 |
| WO | WO 2009/130198 A2 | 10/2009 |
| WO | WO 2009/135888 A2 | 11/2009 |
| WO | WO 2009/137254 A2 | 11/2009 |
| WO | WO 2009/140015 A2 | 11/2009 |
| WO | WO 2009/149303 A1 | 12/2009 |
| WO | WO 2009/158511 A1 | 12/2009 |
| WO | WO 2009156137 A1 | 12/2009 |
| WO | WO 2010/010051 A1 | 1/2010 |
| WO | WO 2010060081 A1 | 5/2010 |
| WO | WO 2010/062768 A1 | 6/2010 |
| WO | WO 2010/091122 A1 | 8/2010 |
| WO | WO 2010111414 A1 | 9/2010 |
| WO | WO 2010/133834 A2 | 11/2010 |
| WO | WO 2010/144502 A2 | 12/2010 |
| WO | WO 2010/144508 A1 | 12/2010 |
| WO | WO 2011020866 A2 | 2/2011 |
| WO | WO 2011/028228 A1 | 3/2011 |
| WO | WO 2011/028229 A1 | 3/2011 |
| WO | WO 2011/028344 A2 | 3/2011 |
| WO | WO 2011/041770 A1 | 4/2011 |
| WO | WO 2011/043568 A1 | 4/2011 |
| WO | WO 2011060242 A2 | 5/2011 |
| WO | WO 2011069164 A2 | 6/2011 |
| WO | WO 2011/084808 A2 | 7/2011 |
| WO | WO 2011/101267 A1 | 8/2011 |
| WO | WO 2011101242 A1 | 8/2011 |
| WO | WO 2011101284 A1 | 8/2011 |
| WO | WO 2011/123813 A2 | 10/2011 |
| WO | WO 2011133637 A2 | 10/2011 |
| WO | WO 2012/006624 A2 | 1/2012 |
| WO | WO 2012/007324 A2 | 1/2012 |
| WO | WO 2012006623 A1 | 1/2012 |
| WO | WO 2012006633 A1 | 1/2012 |
| WO | WO 2012006635 A1 | 1/2012 |
| WO | WO 2012/170969 A2 | 12/2012 |
| WO | WO 2013/009627 A2 | 1/2013 |
| WO | WO-2013009627 A2 * | 1/2013 ........... C07K 14/755 |
| WO | WO 2013083858 A1 | 6/2013 |
| WO | WO 2013/106786 A2 | 7/2013 |
| WO | WO 2013/106787 A1 | 7/2013 |
| WO | WO 2013/106789 A1 | 7/2013 |
| WO | WO 2013/122617 A1 | 8/2013 |
| WO | WO 2013123457 A1 | 8/2013 |
| WO | WO 2013/160005 A1 | 10/2013 |
| WO | WO 2013/189827 A1 | 12/2013 |
| WO | WO-2014011819 A2 * | 1/2014 ............. A61K 38/36 |
| WO | WO 2014011819 A2 | 1/2014 |
| WO | WO 2014/070953 A1 | 5/2014 |
| WO | WO 2014/101287 A1 | 7/2014 |
| WO | WO 2014/144549 A1 | 9/2014 |
| WO | WO 2014/173873 A1 | 10/2014 |
| WO | WO 2014/194282 A2 | 12/2014 |

(56) References Cited

FOREIGN PATENT DOCUMENTS

| WO | WO 2014/198699 A2 | 12/2014 | |
|---|---|---|---|
| WO | WO 2014210448 A1 | 12/2014 | |
| WO | WO 2014210547 A1 | 12/2014 | |
| WO | WO 2014210558 A1 | 12/2014 | |
| WO | WO 2015/021423 A2 | 2/2015 | |
| WO | WO 2015/023891 A2 | 2/2015 | |
| WO | WO 2015/106052 A1 | 7/2015 | |
| WO | WO-2015106052 A1 * | 7/2015 | ............... A61P 7/04 |
| WO | WO 2015/185758 A2 | 12/2015 | |
| WO | WO 2016/025764 A2 | 2/2016 | |
| WO | WO 2013122617 A1 | 8/2016 | |
| WO | WO 2017/024060 A1 | 2/2017 | |
| WO | WO 2017/117630 A1 | 7/2017 | |
| WO | WO 2017/117631 A1 | 7/2017 | |
| WO | WO 2017/222337 A1 | 12/2017 | |
| WO | WO 2018/087271 A1 | 5/2018 | |
| WO | WO 2018/102743 A1 | 6/2018 | |
| WO | WO 2019/222682 A1 | 11/2019 | |
| WO | WO 2021/257899 A1 | 12/2021 | |
| WO | WO 2002/040544 A2 | 5/2022 | |

OTHER PUBLICATIONS

Johns Hopkins medicine. Marlene Williams. What Are Platelets and Why Are They Important? Accessed Jan. 20, 2022 at https://www.hopkinsmedicine.org/health/conditions-and-diseases/what-are-platelets-and-why-are-they-important. (Year: 2010).*

Feb. 28, 2006-Mar. 2, 2006) "Report of Expert Meeting on FVIII Products and Inhibitor Development", European Medicines Agency, 32 Pages.

Agersoe, et al. (2011) "Prolonged effect of N8-Gp in haemophilia A dogs supports less frequent dosing", Journal of Thrombosis and Haemostasis, vol. 9, Supplement 2, ISTH meeting, abstract #P-MO-181, p. 115.

Armour, et al. (Aug. 1999) "Recombinant Human IgG Molecules Lacking Fc gamma Receptor I Binding and Monocyte Triggering Activities", European Journal of Immunology, vol. 29, No. 8, pp. 2613-2624.

Arnau, et al. (Jul. 2006) "Current Strategies for The Use of Affinity Tags and Tag Removal for the Purification of Recombinant Proteins", Protein Expression and Purification, vol. 48, No. 1, pp. 1-13.

Astermark, et al. (Dec. 1, 2006) "Polymorphisms in the TNFA Gene and the Risk of Inhibitor Development in Patients with Hemophilia A", Hemostasis, Thrombosis, and Vascular Biology, Blood, vol. 108, No. 12, pp. 3739-3745.

Bai, et al. (May 17, 2005) "Recombinant Granulocyte Colony-Stimulating Factor-Transferrin Fusion Protein as an Oral Myelopoietic Agent", Proceedings of the National Academy of Sciences of the United States of America, vol. 102, No. 20, pp. 7292-7296.

Bovenschen, et al. (2005) "LDL receptor cooperates with LDL receptor-related protein in regulating plasma levels of coagulation factor VIII in vivo", Blood, vol. 106, pp. 906-912.

Brandsma, et al. (Mar.-Apr. 2011) "Recombinant Human Transferrin: Beyond Iron Binding and Transport", Biotechnology Advances, vol. 29, No. 2, pp. 230-238.

Cameron, et al. (Feb. 1998) "The Canine Factor VIII cDNA and 5'Flanking Sequence", Journal of Thrombosis and Haemostasis, vol. 79, No. 2, pp. 317-322.

Capon, et al. (Feb. 9, 1989) "Designing CD4 Immunoadhesins For AIDS Therapy", Nature, vol. 337, No. 6207, pp. 525-531.

Coppola, et al. (Feb. 2012) "Prophylaxis in Children with Hemophilia: Evidence-Based Achievements, Old and New Challenges", Seminars in Thrombosis and Hemostasis, vol. 38, No. 1, pp. 79-94.

Cutler, et al. (2002) "The Identification and Classification of 41 Novel Mutations in the Factor VIII Gene (F8c)", Human Mutation, vol. 19, No. 3, pp. 274-278.

Dennis, et al. (Sep. 20, 2002) "Albumin Binding as a General Strategy for Improving the Pharmacokinetics of Proteins", Journal of Biological Chemistry, vol. 277, No. 38, pp. 35035-35043.

Drager et al., "Paper: Recombinant FVIIIFc-VWF-XTEN Demonstrates Significant Bioavailability Following Subcutaneous Administration in Hemophilia A Mice", Blood, vol. 126, Issue 23, Dec. 7, 2015.

Dumont, et al. (Mar. 29, 2012) "Prolonged Activity of a Recombinant Factor VIII-Fc Fusion Protein in Hemophilia A Mice and Dogs", Blood, vol. 119, No. 13, pp. 3024-3030.

Eaton, et al. (Dec. 1986) "Construction and Characterization of An Active Factor VIII Variant Lacking the Central One-Third of the Molecule", Biochemistry, vol. 25, No. 26, pp. 8343-8347.

Francis, G E. (1992) "Protein Modification and Fusion Proteins", Focus on Growth Factors, vol. 3, No. 2, Mediscript, England, pp. 4-10.

Friend, et al. (Dec. 15, 1999) "Phase I Study of An Engineered Aglycosylated Humanized CD3 Antibody in Renal Transplant Rejection1", Transplantation, vol. 68, Issue 11, pp. 1632-1637.

Genbank Database (Jan. 14, 1995) "Human Transferrin mRNA, Complete cds", GenBank Accession No. M12530.1, Available at http://www.ncbi.nlm.nih.gov/nuccore/M1253014, 2 pages.

Genbank Database (May 7, 1993) "Transferrin [human, liver, mRNA, 2347 nt]", Accession No. S95936.1, accessed at http://www.ncbi.nlm.nih.gov/nuccore/S95936, 2 pages.

Genbank Database (May 13, 2002) "*Homo sapiens* Transferrin (TF), mRNA", GenBank accession No. XM002793, accessed at https://www.ncbi.nlm.nih.gov/nuccore/XM_002793.7?report=genbank, accessed on Sep. 24, 2014, 2 Pages.

Genbank Database (Jul. 16, 2001) "*Homo sapiens* Transferrin (TF), mRNA", GenBank accession No. XM039845, accessed at https://www.ncbi.nlm.nih.gov/nuccore/XM_039845.1?report=genbank, 2 Pages.

Genbank Database (Jul. 16, 2001) "*Homo sapiens* Transferrin (TF), mRNA", GenBank accession No. XM039847, accessed at https://www.ncbi.nlm.nih.gov/nuccore/XM_039847.1?report=genbank, accessed on Sep. 24, 2014, 2 pages.

Genbank Database (May 25, 2014) "*Homo sapiens* Transferrin (TF), Transcript Variant 1, mRNA", Accession No. NM001063.3, accessed at http://www.ncbi.nlm.nih.gov/nuccore/NM_001063, 5 Pages.

Genbank Database (Mar. 29, 2016) "*Homo sapiens* von Willebrand Factor (VWF), mRNA", NCBI Reference Sequence: NM_000552.3, accessed at https://www.ncbi.nlm.nih.gov/nuccore/NM_000552.3, 10 Pages.

Genbank Database (Mar. 29, 2016) "Von Willebrand Factor Preproprotein [*Homo sapiens*]", NCBI Reference Sequence: NP_000543.2, accessed at http://www.ncbi.nlm.nih.gov/protein/NP_000543.2, 8 Pages.

Gitschier, et al. (Nov. 22-28, 1984) "Characterization of the Human Factor VIII Gene", Nature, vol. 312, No. 5992, pp. 326-330.

Graw, et al. (Jun. 2005) "Haemophilia A: From Mutation Analysis to New Therapies", Nature Reviews Genetics, vol. 6, No. 6, pp. 488-501.

Healey, et al. (Dec. 1, 1996) "The cDNA And Derived Amino Acid Sequence of Porcine Factor VIII", Blood, vol. 88, No. 11, pp. 4209-4214.

Ho, et al. (Apr. 15, 1989) "Site-Directed Mutagenesis by Overlap Extension Using the Polymerase Chain Reaction", Gene, vol. 77, No. 1, pp. 51-59.

Hoeben, et al. (1990) "Expression of Functional Factor Viii in Primary Human Skin Fibroblasts After Retrovirus-Mediated Gene Transfer", Journal of Biological Chemistry, vol. 265, No. 13, pp. 7318-7323.

Holt, et al. (May 2008) "Anti-Serum Albumin Domain Antibodies for Extending the Half-Lives of Short Lived Drugs", Protein Engineering, Design and Selection, vol. 21, No. 5, pp. 283-288.

Horton, et al. (1993) "Gene Splicing by Overlap Extension", Methods in Enzymology, vol. 217, pp. 270-279.

Hubbard, et al. (May 2013) "Recommendations on The Potency Labelling of Factor VIII and Factor IX Concentrates.", Journal of thrombosis and Haemostasis, vol. 11, Issue 5, pp. 988-989.

International Search Report and Written Opinion in related PCT Application No. PCT/US2019/032956 dated Oct. 4, 2019 (13 pages).

(56) References Cited

OTHER PUBLICATIONS

Israel, et al. (Sep. 1997) "Expression of the Neonatal Fc Receptor, FcRn, On Human Intestinal Epithelial Cells", Immunology, vol. 92, No. 1, pp. 69-74.
Jiménez-Yuste, et al. (Jul. 2014) "Achieving and Maintaining an Optimal Trough Level for Prophylaxis in Haemophilia: The Past, The Present and The Future", Blood Transfusion, vol. 12, No. 3, pp. 314-319.
Kamal (Jul. 2007) "How to Interpret and Pursue an Abnormal Prothrombin Time, Activated Partial Thromboplastin Time, and Bleeding Time in Adults", Mayo Clinic Proceedings, vol. 87, No. 7, pp. 863-874.
Kim, et al. (Sep. 2010) "Transferrin Fusion Technology: A Novel Approach to Prolonging Biological Half-Life of Insulinotropic Peptides", Journal of Pharmacology and Experimental Therapeutics, vol. 334, No. 3, pp. 682-692.
Kobayashi, et al. (Feb. 2002) "FcRn-Mediated Transcytosis of Immunoglobulin G in Human Renal Proximal Tubular Epithelial Cells", American Journal of Physiology-Renal Physiology, vol. 282, No. 2, pp. F358-F365.
Kraulis, et al. (Jan. 8, 1996) "The Serum Albumin-Binding Domain of Streptococcal Protein G is A Three-Helical Bundle: A Heteronuclear NMR Study", FEBS Letters, vol. 378, Issue 2, pp. 190-194.
Langner, et al. (Apr. 1988) "Synthesis of Biologically Active Deletion Mutants of Human Factor VIII:C", Behring Institute Mitteilungen, No. 82, pp. 16-25.
Larrick, et al. (1989) "Rapid Cloning of Rearranged Immunoglobulin Genes from Human Hybridoma Cells using Mixed Primers and the Polymerase Chain Reaction", Biochemical and Biophysical Research Communications, vol. 160, No. 3, pp. 1250-1256.
Lee, et al. (Aug. 31, 2001) "Disorders of Coagulation", Pediatric Hematology Secrets, Weiner M.A. and Cario, M.S., eds., Hanley & Belfus, United States, pp. 47-52.
Lenting, et al. (May 2010) "The disappearing act of factor VIII", Haemophilia, vol. 16, No. 102, pp. 6-15.
Li, H, et al. (May 2002) "The Role of the Transferrin-Transferrin-Receptor System in Drug Delivery and Targeting", Trends in Pharmacological Sciences, vol. 23, No. 5, pp. 206-209.
Lillicrap, D. (2008) "Extending Half-Life in Coagulation Factors: Where Do We Stand?", Thrombosis Research, vol. 122, Supplement 4, pp. S2-S8.
Linhult, et al. (Feb. 2002) "Mutational Analysis of the Interaction Between Albumin-Binding Domain from Streptococcal Protein G and Human Serum Albumin", Protein Science, vol. 11, No. 2, pp. 206-213.
Liu, et al. (2007) "Evaluation of PEG-FVIII Molecules with Prolonged Half-lives in a Murine FVIII Dependent Bleeding Model", Journal of Thrombosis and Haemostasis, vol. 9, Suppl. 2: #P-M-035, ISTH Meeting, Poster: Factor VIII, Factor V, Exhibition Area, International Society on Thrombosis and Haemostasis, United States, 1 page.
Liu, et al. (2011) "Recombinant FVIII Fc Fusion Protein is Fully Active in Treating Acute Injury and Demonstrates Prolonged Prophylactic Efficacy in Hemophilia a Mice", Journal of Thrombosis and Haemostasis, vol. 9, (Suppl. 2), ISTH meeting abstract #P-WE-131, International Society on Thrombosis and Haemostasis, United States (Jul. 27, 2011), 561 Page.
Malik, et al. (Sep. 1992) "Polyethylene Glycol (PEG)-Modified Granulocyte-Macrophage Colony-Stimulating Factor (GM-CSF) with Conserved Biological Activity", Experimental Hematology, vol. 20, No. 8, pp. 1028-1035.
Manco-Johnson, et al. (Aug. 9, 2007) "Prophylaxis Versus Episodic Treatment to Prevent Joint Disease in Boys with Severe Hemophilia", The new England journal of medicine, vol. 357, No. 6, pp. 535-544.
Martinelli, et al. (2010) "Polymorphisms at LDLR Locus May Be Associated with Coronary Artery Disease Through Modulation of Coagulation Factor VIII Activity and Independently from Lipid Profile", Blood, vol. 116, pp. 5688-5697.

Mei, et al. (Jul. 15, 2010) "Rational Design of a Fully Active, Long-Acting PEGylated Factor VIII for Hemophilia A Treatment", Blood, vol. 116, No. 2, pp. 270-279.
Meulien, et al. (1988) "A New Recombinant Procoagulant Protein Derived from the cDNA Encoding Human Factor VIII", Protein Engineering, Design and Selection, vol. 2, No. 4, pp. 301-306.
Miao, et al. (May 1, 2004) "Bioengineering of Coagulation Factor VIII for Improved Secretion", Blood, vol. 103, No. 9, pp. 3412-3419.
Muller, et al. (Aug. 2007) "Recombinant Bispecific Antibodies for Cellular Cancer Immunotherapy", Current opinion in molecular therapeutics, vol. 9, No. 4, pp. 319-326.
Oldenburg, Johannes, et al. (Mar. 26, 2015) "Optimal Treatment Strategies for Hemophilia: Achievements and Limitations of Current Prophylactic Regimens", Blood, vol. 125, No. 13, pp. 2038-3044.
Pattarroyo-White et al., "OR413: a FVIII/VWF chimeric protein with VWF independent pharmacokinetic properties", Journal of Thrombosis and Haemostasis; Abstracts of the XXV Congress of the International Society of Thrombosis and Haemostasis, Jun. 20-25, 2015, vol. 13, Suppl. 2, Jun. 1, 2015.
Pierce, Glenn, MD, Ph.D., "Innovation in Hemophilia: From Blood to Genes, and the Unintended Consequences Along the Way", ISPE Annual Meeting & Expo, Oct. 29-Nov. 1, 2017, https://www2.ispe.org/imis/conference-handouts/NA17CEOCT1/Pierce_NA17CEOCT1_Innovation-in-Hemophilia-From-Blood-to-Genes-and-the-Unintended-Consequences-Along-the-Way.pdf.
Pipe, et al. (2011) "Functional Factor VIII Made with Von Willebrand Factor at High Levels in Transgenic Milk", Journal of Thrombosis and Haemostasis, vol. 9, No. 11, pp. 2235-2242.
Pipe, et al. (Oct. 20, 2016) "Life in the Shadow of a Dominant Partner: The FVIII-VWF Association and its Clinical Implications for Hemophilia A", Blood, vol. 128, No. 16, pp. 2007-2016.
Powell, et al. (Mar. 29, 2012) "Safety and Prolonged Activity of Recombinant Factor VIII Fc fusion protein in Hemophilia A Patients", Blood, vol. 119, No. 13, pp. 3031-3037.
Roovers, et al. (Mar. 2007) "Efficient Inhibition of EGFR Signaling and of Tumour Growth by Antagonistic anti-EFGR Nanobodies", Cancer Immunology, Immunotherapy, vol. 56, No. 3, pp. 303-317.
Roth, et al. (1993) "Expression of Polysialic Acid in Human Tumors and Its Significance for Tumor Growth", Polysialic Acid from Microbes to Man, pp. 335-348.
Routledge, et al. (Oct. 1, 1995) "The Effect of Aglycosylation on the Immunogenicity of a Humanized Therapeutic CD3 Monoclonal Antibody", Transplantation, vol. 60, No. 8, pp. 847-853.
Ruberti, et al. (Jul. 12, 1994) "The Use of The RACE Method to Clone Hybridoma cDNA When V Region Primers Fail", Journal of Immunological Methods, vol. 173, No. 1, pp. 33-39.
Sarver, et al. (Dec. 1987) "Stable Expression of Recombinant Factor Viii Molecules Using A Bovine Papillomavirus Vector", DNA, vol. 6, No. 6, pp. 553-564.
Schlapschy, et al. (Jun. 1, 2007) "Fusion of A Recombinant Antibody Fragment with A Homo-Amino-Acid Polymer: Effects on Biophysical Properties and Prolonged Plasma Half-Life", Protein Engineering, Design and Selection, vol. 20, No. 6, pp. 273-284.
Shields, et al. (Mar. 2, 2001) "High Resolution Mapping of The Binding Site on Human IgG1 for Fc Gamma RI, Fc Gamma RII, Fc Gamma RIII, and FcRn and Design of IgG1 Variants with Improved Binding to The Fc Gamma R", Journal of Biological Chemistry, vol. 276, No. 9, pp. 6591-6604.
Smith, et al. (Dec. 1981) "Comparison of Biosequences" Advances in Applied Mathematics, vol. 2, No. 4, pp. 482-489.
Sommermeyer, et al. (1987) "Klinisch verwendete Hydroxyethylstärke: physikalisch chemische Charakterisierung", Krankenhauspharmazie, vol. 8, No. 8, Deutscher Apotheker Verlag, Birkenwaldstr, Germany, pp. 271-278.
Story, et al. (Dec. 1, 1994) "A Major Histocompatibility Complex Class I-like Fc Receptor Cloned from Human Placenta: Possible Role in Transfer of Immunoglobulin G from Mother to Fetus", Journal of Experimental Medicine, vol. 180, No. 6, pp. 2377-2381.

(56) References Cited

OTHER PUBLICATIONS

Toole, et al. (Aug. 1986) "A Large Region (Approximately Equal To 95 kDa) of Human Factor VIII Is Dispensable For in Vitro Procoagulant Activity", Proceedings of the National Academy of Sciences, vol. 83, No. 16, pp. 5939-5942.

Toole, et al. (Nov. 22-28, 1984) "Molecular Cloning of a cDNA Encoding Human Antihaemophilic Factor", Nature, vol. 312, No. 5992, pp. 342-347.

Trussel, et al. (Dec. 2009) "New Strategy for The Extension of The Serum Half-Life of Antibody Fragments", Bioconjugate Chemistry, vol. 20, No. 12, pp. 2286-2292.

Vehar, et al. (Nov. 1984) "Structure of Human Factor VIII", Nature, vol. 312, No. 5992, pp. 337-342.

Wang, et al. (Nov. 7, 2011) "Receptor-Mediated Activation of a Proinsulin-Transferrin Fusion Protein in Hepatoma Cells", Journal of Controlled Release, vol. 155, No. 3, pp. 386-392.

Ward, et al. (Apr. 1995) "The Effector Functions of Immunoglobulins: Implications for Therapy", Therapeutic immunology, vol. 2, No. 2, pp. 77-94.

Weidler, et al. (May 1991) "Pharmacokinetic Parameters as Criteria for Clinical Use of Hydroxyethyl Starch Preparations", Arzneimittelforschung/Drug Research, vol. 41, No. 5, pp. 494-498.

Wood, et al. (Nov. 22-28, 1984) "Expression of Active Human Factor VIII from Recombinant DNA Clones", Nature, vol. 312, No. 5992, pp. 330-337.

Zhou, et al. (Apr. 6, 2012) "Sequence and Structure Relationships within von Willebrand Factor", Blood First Edition Paper, DOI 10.1182/blood-2012-01-405134, pp. 1-38.

Alvarez et al., "Improving protein pharmacokinetics by genetic fusion to simple amino acid sequences", J Biol Chem, 2004, vol. 279, No. 5, pp. 3375-3381.

Burmeister et al., "Crystal structure of the complex of rat neonatal Fc receptor with Fc", Nature, 1994, vol. 372, pp. 379-383.

Caliceti, P., et al., "Biopharmaceutical Properties of Uricase Conjugated to Neutral and Amphiphilic Polymers," Bioconjugate Chemistry 10(4):638-646, American Chemical Society, United States (1999).

Cho, J.W. and Troy, F.A. II, "Polysialic Acid Engineering: Synthesis of Polysialylated Neoglycosphingolipids by Using the Polysialyltransferase from Neuroinvasive *Escherichia coli* K1," Proceedings of the National Academy of Sciences USA 91(24):11427-11431, National Academy of Sciences, United States (1994).

Counts, R. B., et al., "Disulfide Bonds and the Quaternary Structure of Factor VIII/von Willebrand Factor," J. Clin. Invest. 62(3):702-09, The American Society for Clinical Investigation, Inc. (1978).

Delgado, C., et al., "The Uses and Properties of PEG-Linked Proteins," Critical Reviews in Therapeutic Drug Carrier Systems 9(3-4):249-304, CRC Press, Inc., United States (1992).

Engels, et al., "Gene Synthesis," Angewandte Chemie International Edition, 28(6):716-734, VCH Verlagsgesellschaft mbH, Germany (1989).

Goudemand et al., "Pharmacokinetic studies on Wilfactin, a von Willebrand factor concentrate with a low factor VIII content treated with three virus-inactivation/removal methods", J Thromb Haemost., 2005, vol. 3, No. 10, pp. 2219-2227.

International Preliminary Report on Patentability for PCT International Patent Application No. PCT/US2014/044718, ISA/US, dated Dec. 29, 2015, 7 pages.

International Preliminary Report on Patentability for PCT International Patent Application No. PCT/US2015/010738, ISA/US, dated Jul. 12, 2016, 10 pages.

International Preliminary Report on Patentability for PCT International Patent Application No. PCT/US2013/021330, ISA/US, dated Jul. 15, 2014, 5 pages.

International Preliminary Report on Patentability for PCT International Patent Application No. PCT/US2013/049989, ISA/US, dated Jan. 13, 2015, 10 pages.

International Preliminary Report on Patentability for PCT International Patent Application No. PCT/US2014/044731, ISA/US, dated Dec. 29, 2015, 8 pages.

International Search Report and Written Opinion for PCT International Patent Application No. PCT/US2014/044718, ISA/US, dated Nov. 4, 2014, 10 pages.

International Search Report and Written Opinion for PCT International Patent Application No. PCT/US2015/010738, ISA/US, dated May 15, 2015, 4 pages.

International Search Report and Written Opinion for PCT International Patent Application No. PCT/US2013/021330, ISA/US, dated Apr. 29, 2013, 4 pages.

International Search Report and Written Opinion for PCT International Patent Application No. PCT/US2013/049989, ISA/US, dated Dec. 16, 2013, 5 pages.

International Search Report and Written Opinion for PCT International Patent Application No. PCT/US2014/044731, ISA/US, dated Nov. 4, 2014, 4 pages.

Konig et al., "Use of an Albumin-Binding Domain for the Selective Immobilisation of Recombinant Capture Antibody Fragments on ELISA Plates," Journal of Immunological Methods 218(1-2):73-83, Elsevier Science B.V., Netherlands (1998).

Lenting, P.J., et al., "Clearance Mechanisms of Von Willebrand Factor and Factor VIII," Journal of Thrombosis and Haemostasis 5(7):1353-1360, International Society on Thrombosis and Haemostasis, England (2007).

Lenting, P.J., et al., "The Life Cycle of Coagulation Factor VIII in View of its Structure and Function," Blood, 92(11):3983-3996, American Society of Hematology, United States (1998).

Leyte, A., et al., "Sulfation of Tyr1680 of human blood coagulation factor VIII is essential for the interaction of factor VIII with Von Willebrand Factor," J Biol Chem 266(2):740-746, American Society for Biochemistry and Molecular Biology, United States (1991).

Logan, J., et al., "Adenovirus Tripartite Leader Sequence Enhances Translation of mRNAs Late After Infection," Proceedings of the National Academy of Sciences USA 81(12):3655-3659, National Academy of Sciences, United States (Jun. 1984).

Mackett, M., et al., "General Method for Production and Selection of Infectious Vaccinia Virus Recombinants Expressing Foreign Genes," Journal of Virology 49(3):857-864, American Society for Microbiology, United States (Mar. 1984).

Mackett, M., et al., "Vaccinia Virus: A Selectable Eukaryotic Cloning and Expression Vector," Proceedings of the National Academy of Sciences USA 79(23):7415-7419, National Academy of Sciences, United States (Dec. 1982).

Mccue, J.T., et al., "Application of a Novel Affinity Adsorbent for the Capture and Purification of Recombinant Factor VIII Compounds," Journal of Chromatography A 1216(45):7824-7830, Elsevier, Netherlands (2009).

Mei, B., et al., "Expression of Human Coagulation Factor VIII in a Human Hybrid Cell Line, HKB11," Molecular Biotechnology 34(2):165-178, Humana Press Inc., United States (Oct. 2006).

Meloun, et al., "Complete Amino Acid Sequence of Human Serum Albumin," FEBS LETTERS:134-137, Wiley Online Library, United States (1975).

Morpurgo, M., et al., "Covalent Modification of Mushroom Tyrosinase with Different Amphiphic Polymers for Pharmaceutical and Biocatalysis Applications," Applied Biochemistry and Biotechnology 56(1):59-72, Humana Press, Inc., United States (1996).

Mount, J.D., et al., "Sustained Phenotypic Correction of Hemophilia B dogs with a Factor IX Null Mutation by Liver-directed Gene Therapy," Blood 99(8):2670-2676, The American Society of Hematology, United States (Apr. 2002).

National Heart Lung and Blood Institute, "The Diagnosis, Evaluation and Management of von Willebrand Disease Scientific Overview," accessed at http://www.nhlbi.nih.gov/guidelines/vwd/2scientificoverview.htm, accessed on Oct. 22, 2011.

Neumann, E., et al., "Gene Transfer into Mouse Lyoma Cells by Electroporation in High Electric Fields," The EMBO Journal 1(7):841-845, IRL Press Limited, England (Feb. 1982).

Newell et al., Acidic Residues C-terminal to the A2 domain Facilitate Thrombin-Catalyzed Activation of Factor VIII, Biochemistry, vol. 47:8786-8795 (2008).

Newell et al., Residues Surrounding Arg372, Arg740, and Arg1689 Contribute to the Rates of Thrombin-Catalyzed Cleavage of Factor VIII (Meeting Abstract), Blood, vol. 114(22):349 (Nov. 20, 2009).

(56) References Cited

OTHER PUBLICATIONS

Ngo, J., et al., "Crystal Structure of Human Factor VIII: Implications for the formation of the Factor IXa-Factor VIIIa complex," Structure 16: 597-606, Elsevier, Netherlands (2008).
Nieman, M.T., et al., "Interaction of thrombin with PAR1 and PAR4 at the thrombin cleavage site," Biochemistry 46(29):8603-8610, American Chemistry Society, United States (2007).
Nogami, K., et al., "A novel mechanism of factor VIII protection by von Willebrand factor from activated protein C-catalyzed inactivation," Blood 99(11):3993-98, American Society of Hematology (2002).
Nogami, K., et al., "Relationship between the binding sites for von Willebrand factor, phospholipid, and human factor VIII C2 inhibitor alloantibodies within the factor VIII C2 domain," Int. J. Hematol. 85(4):317-22, Springer (2007).
Office Action dated Apr. 30, 2018, in U.S. Appl. No. 14/379,196, inventor Kulman, J., et al., filed Aug. 15, 2014.
Office Action dated Dec. 12, 2017, in U.S. Appl. No. 14/371,948 inventor Ekta Seth Chhabra, filed Jul. 11, 2014.
Office Action dated Dec. 15, 2017, in U.S. Appl. No. 14/894,108, inventor Ekta Seth Chhabra, filed May 3, 2016.
Office Action dated Jan. 26, 2018, in U.S. Appl. No. 14/895,264 inventor Ekta Seth Chhabra, filed Dec. 2, 2015.
Office Action dated Jul. 21, 2017, in U.S. Appl. No. 14/413,765, inventor Ekta Seth Chhabra, filed Jul. 10, 2013.
Office Action dated Jul. 21, 2017, in U.S. Appl. No. 14/413,765 inventor Ekta Seth Chhabra, filed Jan. 9, 2015.
Office Action dated Jun. 18, 2020, for U.S. Appl. No. 16/154,310, inventor Ekta Seth Chhabra, filed Oct. 8, 2018.
Office Action dated Jun. 25, 2018, in U.S. Appl. No. 14/371,948 inventor Ekta Seth Chhabra, filed Jul. 11, 2014.
Office Action dated Mar. 29, 2017, in U.S. Appl. No. 14/413,765 inventor Ekta Seth Chhabra, filed Jan. 9, 2015.
Office Action dated Mar. 9, 2020, for U.S. Appl. No. 14/371,948, inventor Ekta Seth Chhabra, filed Jul. 11, 2014.
Office Action dated May 17, 2019, for U.S. Appl. No. 14/894,108, inventor Ekta Seth Chhabra, filed May 3, 2016.
Office Action dated May 21, 2020, for U.S. Appl. No. 14/894,108, inventor Ekta Seth Chhabra, filed May 3, 2016.
Office Action dated May 23, 2017, in U.S. Appl. No. 14/894,108, inventor Ekta Seth Chhabra, filed May 3, 2016.
Office Action dated Nov. 18, 2019, for U.S. Appl. No. 14/895,264, inventor Ekta Seth Chhabra, filed Dec. 2, 2015.
Office Action dated Sep. 19, 2019, for U.S. Appl. No. 14/371,948, inventor Ekta Seth Chhabra, filed Jul. 11, 2014.
Office Action dated Sep. 25, 2017, in U.S. Appl. No. 14/379,196, inventor Kulman, J., et al., filed Aug. 15, 2014.
Office Action dated Sep. 5, 2018, in U.S. Appl. No. 14/379,196, inventor Kulman, J., et al., filed Aug. 15, 2014.
Office Action dated Sep. 7, 2018, in U.S. Appl. No. 14/895,264 inventor Ekta Seth Chhabra, filed Dec. 2, 2015.
Office Action dated, Apr. 17, 2019 in U.S. Appl. No. 15/110,673 inventor Ekta Seth Chhabra, filed Jul. 8, 2016.
Office Action dated, Oct. 29, 2019 in U.S. Appl. No. 15/110,673 inventor Ekta Seth Chhabra, filed Jul. 8, 2016.
Panicali, D., et al., "Construction of Poxviruses as Cloning Vectors: Insertion of the Thymidine Kinase Gene from Herpes Simplex Virus into the DNA of Infectious Vaccinia Virus," Proceedings of the National Academy of Sciences USA 79(16):4927-4931, The National Academy of Sciences of the United States (Aug. 1982).
Pattarroyo-White et al., "A FvIII/VWF Chimeric Protein with VWF Independent Pharmacokinetic Properties", XXV Congress of the International Society of Thrombosis and Haemostasis (ISTH), Jun. 20-25, 2015, Toronto, Canada.
Peters et al., "Biochemical and functional characterization of a recombination monomeric factor VIII-fc fusion protein; Journal of thrombosis and haemostasis," J. Thromb Haemost. 11(1):132-141, Wiley Online library, United States (2013).
Pool, J.G., et al., "Ineffectiveness of intramuscularly injected Factor 8 concentrate in two hemophilic patients," The New England Journal of Medicine 275(10):547-548, Massachusetts Medical Society, United States (1966).
Proft, T., "Sortase-mediated protein ligation: an emerging biotechnology tool for protein modification and immobilization," Biotechnology Letters 32:1-10, Springer Science+Business Media B.V., Netherlands (Sep. 2009).
Roth, J. et al., "From Microbes to Man" in Polysialic Acid, Roth J., Rutishauser U., Troy F.A., eds., pp. 335-348, BirkhauserVerlag, Basel, Switzerland (1993).
Ruther, U. and Muller-Hill, B., "Easy Identification of cDNA Clones," The EMBO Journal 2(10):1791-1794, IRL Press Ltd, England (1983).
Saenko, E. L., et al., "A Role for the C2 domain of factor VIII in binding to von Willebrand Factor," Journal of Biological Chemistry 269:11601-11605, American Society for Biochemistry and Molecular Biology, United States (1994).
Schellenberger, V., et al., "A Recombinant Polypeptide Extends the in Vivo Half-life of Peptides and Proteins in a Tunable Manner," Nature Biotechnology 27(12):1186-1190, Nature America, Inc., United States (Dec. 2009).
Schlapschy, M., et al., "Fusion of a Recombinant Antibody Fragment with a Homo-amino-acid Polymer: Effects on Biophysical Properties and Prolonged Plasma Half-Life," Protein Engineering Design and Selection 20(6):273-284, Oxford University Press, England (2007).
Shen, B.W., et al., "The Tertiary Structure and Domain Organization of Coagulation Factor VIII," Blood 111(3):1240-1247, The American Society of Hematology, United States (2008).
Simonsen, C.C., et al., "Isolation and Expression of an Altered Mouse Dihydrofolate Reductase cDNA," Proceedings of the National Academy of Sciences 80(9):2495-2499, National Academy of Sciences, United States (May 1983).
Smith, G.E., et al., "Molecular Engineering of the Autographa Californica Nuclear Polyhedrosis Virus Genome: Deletion Mutations within the Polyhedrin Gene," Journal of Virology 46(2):584-593, American Society for Microbiology, United States (May 1983).
Terrarube et al., "Factor VIII and von Willebrand factor interaction: biological, clinical and therapeutic importance", Haemophilia(2010), vol. 16, pp. 3-13.
Thermo Scientific, "Instructions: Imidoester Crosslinkers: DMA, DMP, DMS, DTBP," available at https://tools.thermofisher.com/content/sfs/manuals/MAN0011314_ Imidoester CrsLnk_DMA_DMP_DMS_DTBP_UG.pdf, 2 pages (2012).
Thompson, Arthur R., (2003) "Structure and function of the factor VIII gene and protein," Semin Thromb Hemost., 29:11-22.
Venkateswarlu, D., "Structural investigation of zymogenic and activated forms of human blood coagulation factor VIII: a computation molecular dynamics study," BMC structural Biology 10:7, BioMed Central, United Kingdom (2010).
Vorobjev, P.E., et al., "Oligonucleotide Conjugated to Linear and Branched High Molecular Weight Polyethylene Glycol as Substrates for RNase H," Nucleosides & Nucleotides 18(11-12):2745-2750, Marcel Dekker, Inc., United States (1999).
Wigler, M., et al., "Biochemical Transfer of Single-copy Eucaryotic Genes using Total Cellular DNA as Donor," Cell 14(3):725-731, Cell Press, United States (Jul. 1978).
Ashkenazi, et al., "Immunoadhesins", International Reviews of Immunology, vol. 10, Issue 2-3, Harwood Academic Publishers GmbH, United States, pp. 219-227, Jan. 1, 1993.
Berkner, et al., "Expression of Recombinant Vitamin K-Dependent Proteins in Mammalian Cells: Factors IX and VII", Methods in Enzymology, vol. 222, Academic Press, United States, pp. 450-477, Jan. 1, 1993.
Bi, et al., "Targeted Disruption of The Mouse Factor VIII Gene Produces a Model of Haemophilia A", Nature Genetics, vol. 10, No. 1, pp. 119-121, May 1, 1995.
Bitonti, et al., "Pulmonary Administration of Therapeutic Proteins using an Immunoglobulin Transport Pathway", Advanced Drug Delivery Reviews, vol. 58, Issues 9-10, pp. 1106-1118, Oct. 31, 2006.

(56) References Cited

OTHER PUBLICATIONS

Blanchette, et al., "A Survey of Factor Prophylaxis in the Canadian Haemophilia A Population", Haemophilia, vol. 10, Issue 6, Blackwell Publishing, England, pp. 679-683, Nov. 1, 2004.
Blanchette, et al., "Plasma and Albumin-Free Recombinant Factor VIII: Pharmacokinetics", Efficacy and Safety in Previously Treated Pediatric Patients, Journal of Thrombosis and Haemostasis, vol. 6, Issue 8, pp. 1319-1326, Aug. 1, 2008.
Brinkhous, et al., "Preclinical Pharmacology of Albumin-Free B-Domain Deleted Recombinant Factor VIII", Seminars in Thrombosis and Hemostasis, Thieme Medical Publishers, vol. 28, No. 3, pp. 269-272, Jun. 1, 2002.
Brutlag, et al., "Improved Sensitivity of Biological Sequence Database Searches", Computer Applications in the Biosciences: CABIOS, vol. 6, No. 3, pp. 237-245, Aug. 1, 1990.
Chamow, et al., "Immunoadhesins: Principles and Applications", Trends in Biotechnology, vol. 14, No. 2, Elsevier Science Ltd., pp. 52-60, Feb. 1, 1996.
Chang, et al., "Replacing the First Epidermal Growth Factor-like Domain of Factor IX with That of Factor VII Enhances Activity In Vitro and in Canine Hemophilia B", The Journal of Clinical Investigation, vol. 100, No. 4, The American Society for Clinical Investigation, Inc., pp. 886-892, Aug. 15, 1997.
Chaudhury, et al., "Albumin Binding to FcRn: Distinct from the FcRn-IgG Interaction", Biochemistry, vol. 45, No. 15, pp. 4983-4990, Apr. 18, 2006.
Clinicaltrials.gov, "Study of Recombinant Factor VIII Fc Fusion Protein (rFVIIIFc) in Subjects with Severe Hemophilia A", Dec. 4, 2009, ClinicalTrials.gov Identifier: NCT01027377, 3 Pages.
Decision to Grant Received for European Patent Application No. 10835255.0, dated Oct. 19, 2017, 3 Pages.
Decision to Grant Received for European Patent Application No. 17194648.6, dated Mar. 12, 2021, 3 Pages.
Döbeli, et al., "Role of the Carboxy-Terminal Sequence on the Biological Activity of Human Immune Interferon (IFN-y)", Journal of Biotechnology, vol. 7, No. 3, pp. 199-216, Jan. 1, 1988.
Dumont, et al., "Delivery of an Erythropoietin-Fc Fusion Protein by Inhalation in Humans Through an Immunoglobulin Transport Pathway", Journal of Aerosol Medicine, vol. 18, No. 3, pp. 294-303, Sep. 23, 2005.
Dumont, et al., "Factor VIII-Fc Fusion Protein Shows Extended Half-Life and Hemostatic Activity in Hemophilia A Dogs", Abstract 545, Blood, vol. 114, No. 22, 51st Annual Meeting of the American Society of Hematology, 1 Page, Nov. 20, 2009.
Dumont, J A., "Monomeric Fc Fusions: Impact on Pharmacokinetic and Biological Activity of Protein Therapeutics", BioDrugs, vol. 20, No. 3, pp. 151-160, May 1, 2006.
Ellis, et al., "Treatment of Chronic Plaque Psoriasis by Selective Targeting of Memory Effector T Lymphocytes", The New England Journal of Medicine, vol. 345, No. 4, Massachusetts Medical Society, pp. 248-255, Jul. 26, 2001.
English language Abstract of European Patent Publication No. EP0295597 A2, European Patent office, Espacenet database-worldwide, Dec. 21, 1988.
Extended European Search Report received for European Patent Application No. 10835255.0, dated Jun. 20, 2013, 8 Pages.
Extended European Search Report received for European Patent Application No. 17194648.6, dated Apr. 4, 2018, 6 Pages.
Fay, Philip J., "Factor VIII Structure and Function", International Journal of Hematology, vol. 83, No. 2, pp. 103-108, Feb. 1, 2006.
Final Office Action Received for U.S. Appl. No. 13/513,424, dated Oct. 1, 2014, 17 Pages.
Fisher, et al., "Treatment of Septic Shock with the Tumor Necrosis Factor Receptor: Fc Fusion Protein", The New England Journal of Medicine, vol. 334, No. 26, Massachusetts Medical Society, United States, pp. 1697-1702, Jun. 27, 1996.
Gayle, et al., "Identification of Regions in Interleukin-1 Alpha Important for Activity", Journal of Biological Chemistry, vol. 268, No. 29, pp. 22105-22111, Oct. 15, 1993.

Ghetie, et al., "Multiple Roles for The Major Histocompatibility Complex Class I- Related Receptor FcRn", Annual Review of Immunology, vol. 18, pp. 739-766., Jan. 1, 2000.
Graham, et al., "Canine Hemophilia: Observations on the Course, the Clotting Anomaly", and the Effect of Blood Transfusions, Journal of Experimental Medicine, vol. 90, No. 2, pp. 97-111, Aug. 1, 1949.
Hacker et al., "Barriers to compliance with prophylaxis therapy in haemophilia", Haemophilia, 2001 7: 392-396.
Intention to Grant Received for European Patent Application No. 10835255.0, dated Jun. 8, 2017, 6 Pages.
Intention to Grant Received for European Patent Application No. 17194648.6, dated Oct. 28, 2020, 6 Pages.
International Search Report and Written Opinion received for PCT Patent Application No. PCT/US2010/59136, dated Jun. 2, 2011, 11 Pages.
Konkle et al. "BIVV001 Fusion Protein as Factor VIII Replacement Therapy for Hemophilia A", NEJM, 2020, 383: 1018-1027.
Lollar, et al., "Coagulant Properties of Hybrid Human/Porcine Factor VIII Molecules", Journal of Biological Chemistry, vol. 267, p. 23652-23657, Nov. 25, 1992.
Lollar, et al., "Structural Basis for The Deceased Procoagulant Activity of Human Factor VIII Compared to The Porcine Homolog", Journal of Biological Chemistry, vol. 266, Number, pp. 12481-12486, Jul. 5, 1991.
Low, et al., "Oral and Pulmonary Delivery of FSH-Fc Fusion Proteins via Neonatal Fc Receptor-Mediated Transcytosis", Human Reproduction, vol. 20, No. 7, Oxford University Press, pp. 1805-1813, Jul. 1, 2005.
Lozier, et al., "The Chapel Hill Hemophilia A Dog Colony Exhibits a Factor VIII Gene Inversion", Proceedings of the National Academy of Sciences USA, vol. 99, No. 20, pp. 12991-12996, Oct. 1, 2002.
Manco-Johnson, M., "Comparing Prophylaxis with Episodic Treatment in Haemophilia A: Implications for Clinical Practice", Haemophilia., vol. 13, Supplement 2, Blackwell Publishing Ltd., England, pp. 4-9, Sep. 1, 2007.
Mannucci, et al., "The Hemophilias—From Royal Genes to Gene Therapy", New England Journal of Medicine, vol. 344, No. 23, pp. 1773-1779, Jun. 1, 2001.
Morfini, M., "Pharmacokinetics of Factor VIII and Factor IX", Haemophilia, vol. 9, No. 1, pp. 94-99, May 1, 2003.
Non-Final Office Action Received for U.S. Appl. No. 13/513,424, dated May 5, 2014, 11 Pages.
Non-Final Office Action Received for U.S. Appl. No. 13/793,783, dated Mar. 11, 2015, 11 Pages.
Non-Final Office Action Received for U.S. Appl. No. 14/964,289, dated Apr. 10, 2018, 11 Pages.
Non-Final Office Action Received for U.S. Appl. No. 16/270,302, dated Feb. 18, 2021, 12 Pages.
Notice of Allowance Received for U.S. Appl. No. 13/513,424, dated Feb. 3, 2015, 16 Pages.
Notice of Allowance Received for U.S. Appl. No. 13/793,783, dated Sep. 9, 2015, 12 Pages.
Notice of Allowance Received for U.S. Appl. No. 14/964,289, dated Nov. 8, 2018, 9 Pages.
Office Action Received for European Patent Application No. 10835255.0, dated Aug. 6, 2015, 4 Pages.
Office Action Received for European Patent Application No. 10835255.0, dated Feb. 7, 2017, 4 Pages.
Office Action Received for European Patent Application No. 10835255.0, dated Jun. 3, 2016, 3 Pages.
Office Action Received for European Patent Application No. 17194648.6, dated Jul. 10, 2019, 4 Pages.
Office Action Received for European Patent Application No. 17194648.6, dated Mar. 18, 2020, 4 Pages.
Oganesyan, et al., "Structural Characterization of a Human Fc Fragment Engineered for Extended Serum Half-Life", Molecular Immunology, vol. 46, No. 8-9, pp. 1750-1755, May 1, 2009.
Pan, et al., "Enhanced efficacy of recombinant FVIII in noncovalent complex with PEGylated liposome in hemophilia A mice", Blood Journal, vol. 114, No. 13, pp. 2802-2811, Sep. 24, 2009.

(56) References Cited

OTHER PUBLICATIONS

Peyvandi, et al., "Genetic Diagnosis of Haemophilia and Other Inherited Bleeding Disorders", Haemophilia, vol. 12, Suppl 3, pp. 82-89, Jul. 1, 2006.
Pittman, et al., "Biochemical, Immunological, and in Vivo Functional Characterization of B-Domain-Deleted Factor VIII", Blood, vol. 81, pp. 2925-2935, Jan. 1, 1993.
Raut, et al., "Phospholipid Binding of Factor VIII in Different Therapeutic Concentrates", British Journal of Haematology, vol. 107, No. 2, Blackwell Science Ltd, pp. 323-329, Nov. 1, 1999.
Recht, et al., "Clinical Evaluation of Moroctocog Alfa(AF-CC), A New Generation of B-Domain Deleted Recombinant Factor VIII (BDDrFVIII) for Treatment of Haemophilia A: Demonstration of Safety, Efficacy, and Pharmacokinetic Equivalence to Full-Length Recombinant Factor VIII", Haemophilia, vol. 15, No. 4, pp. 869-880, Jul. 1, 2009.
Restriction Requirement received for U.S. Appl. No. 13/513,424, dated Dec. 16, 2013, 8 Pages.
Restriction Requirement received for U.S. Appl. No. 13/793,783, dated Oct. 21, 2014, 6 Pages.
Restriction Requirement received for U.S. Appl. No. 16/270,302, dated Aug. 20, 2020, 8 Pages.
Rodriguez-Merchan, Carlos E., "Management of Musculoskeletal Complications of Hemophilia", Seminars in Thrombosis and Hemostasis, vol. 29, No. 01, pp. 87-96, Jan. 1, 2003.
Ron, et al., "Expression of Biologically Active Recombinant Keratinocyte Growth Factor—Structure/Function Analysis of Amino-Terminal Truncation Mutants", Journal of Biological Chemistry, vol. 268, No. 4, pp. 2984-2988, Jan. 1, 1993.
Roopenian, et al., "FcRn: The Neonatal Fc Receptor Comes of Age", Nature Reviews Immunology, vol. 7, No. 9, pp. 715-725, Sep. 1, 2007.
Röstin, et al., "B-Domain Deleted Recombinant Coagulation Factor VIII Modified with Monomethoxy Polyethylene Glycol", Bioconjugate Chemistry, vol. 11, No. 3, pp. 387-396, May 15, 2000.
Schulte, Stefan, "Half-Life Extension Through Albumin Fusion Technologies", Thrombosis Research, vol. 124, Supplement 2, pp. S6-S8, Dec. 1, 2009.
Schulte, Stefan, "Use of Albumin Fusion Technology to Prolong the Half-Life of Recombinant Factor", Thrombosis Research, vol. 122, Supplement 4, pp. S14-S19, Dec. 1, 2008.
Skinner et al. "WFH: Closing the global gap—achieving optimal care", Haemophilia, 2012, 18(Suppl. 4): 1-12.
Spira, et al., "Evaluation of Liposomal Dose in Recombinant Factor VIII Reconstituted with Pegylated Liposomes for the Treatment of Patients with Severe Haemophilia A", Thrombosis and Haemostasis, vol. 100, No. 4, pp. 429-434, Jan. 1, 2008.
Spira, et al., "Prolonged Bleeding-Free Period Following Prophylactic Infusion of Recombinant Factor VIII Reconstituted with Pegylated Liposomes", Blood, vol. 108, No. 12, pp. 3668-3673, Jan. 1, 2006.
Srour, et al., "Modified Expression of Coagulation Factor VIII by Addition of a Glycosylation Site at the N Terminus of the Protein", Annals of Hematology, vol. 87, Issue 2, pp. 107-112, Feb. 1, 2008.
Stennicke, et al., "Generation and Biochemical Characterization of Glycopegylated Factor VIIa Derivatives", Thrombosis and Haemostasis, vol. 100, No. 5, pp. 920-928, Jan. 1, 2008.
Stieltjes, et al., "Continuous Infusion of B-Domain Deleted Recombinant factor VIII ReFacto) in Patients with Haemophilia a Undergoing Surgery: Clinical Experience", Haemophilia, vol. 10, Issue 5, pp. 452-458, Sep. 1, 2004.
Vaccaro, et al., "Engineering the Fc Region of Immunoglobulin G to Modulate In Vivo Antibody Levels", Nature Biotechnology, vol. 23, No. 10, pp. 1283-1288, Oct. 1, 2005.
White, et al., "A Multicenter Study of Recombinant Factor VIII (Recombinate) In Previously Treated Patients with Hemophilia A: The Recombinate Previously Treated Patient Study Group", Thrombosis and Haemostasis, vol. 77, No. 4, pp. 660-667, Apr. 1, 1997.
U.S. Appl. No. 13/513,424 2013/0108629 U.S. Pat. No. 9,050,318, filed Dec. 28. 2012 May 2, 2013 Jun. 9, 2015, Jennifer A. Dumont.
U.S. Appl. No. 13/793,783 2013/0274194 U.S. Pat. No. 9,241,978, filed May 11, 2013 Oct. 17, 2013 Jan. 26, 2016, Jennifer A. Dumont.
U.S. Appl. No. 16/270,302 2019/0262429, filed Feb. 7, 2019 Aug. 29, 2019, Jennifer A. Dumont.
U.S. Appl. No. 16/415,893 2019/0375822, filed May 17, 2019 Dec. 12, 2019, Ekta Seth Chhabra.
U.S. Appl. No. 14/413,765 2015/0266943 U.S. Pat. No. 10,138,291, filed Jan. 9, 2015 Sep. 24, 2015, Ekta Seth Chhabra.
U.S. Appl. No. 16/154,310 2019/0169267, filed Oct. 8, 2018 Jun. 6, 2019, Ekta Seth Chhabra.
U.S. Appl. No. 14/894,108 2016/0251408, filed May 3, 2016 Sep. 1, 2016, Ekta Seth Chhabra.
U.S. Appl. No. 14/371,948 2015/0023959, filed Jul. 11, 2014 Jan. 22, 2015, Ekta Seth Chhabra.
U.S. Appl. No. 16/357,189, fled Mar. 18, 2019, Ekta Seth Chhabra.
U.S. Appl. No. 14/895,264 2016/0229903, filed Dec. 2, 2015 Aug. 11, 2016, Ekta Seth Chhabra.
U.S. Appl. No. 15/110,673 2017/0073393, filed Jul. 8, 2016 Mar. 16, 2017, Ekta Seth Chhabra.
U.S. Appl. No. 14/379,192 2015/0158929 U.S. Pat. No. 10,421,798, filed Feb. 20, 2015 Jun. 11, 2015 Sep. 24, 2019, Volker Schellenberger.
U.S. Appl. No. 16/521,789 2020/0087379, filed Jul. 25, 2019 Mar. 19, 2020, Volker Schellenberger.
Ahnström et al., "A 6-year follow-up of dosing, coagulation factor levels and bleedings in relation to joint status in the prophylactic treatment of haemophilia", Haemophilia, Nov. 2004, 10(6): 689-697.
Aleman et al., "Recombinant FVIIIFc-VWF-XTEN (BIVV001) promotes normal fibrin formation, structure and stability", International Society on Thrombosis and Haemostasis (ISTH) Congress, Jul. 8-13, 2017, Berlin Germany, 1 page.
Berntorp et al., "Dosing regimens, FVIII levels and estimated haemostatic protection with special focus on rFVIIIFc", Haemophilia, May 2016, 22(3): 389-396.
Chhabra et al., "Application of in silico antigenicity prediction methods to avoid neo-epitopes during the designing of BIIB073, a next generation long acting recombinant Factor VIII (rFVIII) molecule", WFH 2016, World Congress, Jul. 24-28, 2016, Orlando, Florida, USA.
Collins, "Personalized prophylaxis", Haemophilia, 2012, 18(Suppl. 4): 131-135.
Demers et al., "rFVIIIFc-VWF-XTEN (BIVV001) demonstrates comparable efficacy to recombinant human FVIII in mice by acute bleeding and intravital microscopy models", International Society on Thrombosis and Haemostasis (ISTH) Congress, Jul. 8-13, 2017, Berlin Germany, 1 page.
Den Uijl et al., "Analysis of low frequency bleeding data: the association of joint bleeds according to baseline FVIII activity levels", Haemophilia, Jan. 2011, 17(1): 41-44.
Lambert et al., "Practical aspects of extended half-life products for the treatment of haemophilia", Ther Adv Hemat., Sep. 6, 2018, 9(9): 295-308.
Skinner, "WFH: closing the global gap—achieving optimal care", Haemophilia, Jul. 2012, 18(Suppl. 4): 1-12.
Abraham A, et al. Outcome of Immune Tolerance Induction Using an Extended Half-Life Clotting Factor Concentrate—Recombinant Factor VIII Fc (Eloctate T'•')—a Report from India. Blood. 2018:132(S1):2494.
Advate, United States Prescribing Information [USPI], May 2015, Baxter International Inc., The most recent version is available at: http://www.shirecontent.com/PI/PDFs/ADVATE_USA_ENG.pdf.
Adynovate, United States Prescribing Information [USPI], Dec. 2016, Baxalta US Inc., The most recent version is available at: http://www.shirecontent.com/PI/PDFS/ADYNOVATE_USA_ENG.pdf.
Agarwal et al., Retroviral gene therapy with an immunoglobulin-antigen fusion construct protects from experimental autoimmune uveitis, J Clin Invest., 2000, 106(2): 245-252.
Aledort et al., A longitudinal study of orthopaedic outcomes for severe factor-VIII-deficient haemophiliacs, The Orthopaedic Outcome Study Group, J Intern Med. 1994, 236(4): 391-399.

(56) References Cited

OTHER PUBLICATIONS

Astermark et al., The Malmo International Brother Study (MIBS), Genetic defects and inhibitor development in siblings with severe hemophilia A, Haematologica, 2005, 90(7): 924-931.

Aznar et al., Haemophilia in Spain, Haemophilia, 2009, 15(3): 665-675.

Batsuli G, et al. Immune tolerance induction in paediatric patients with haemophilia A and inhibitors receiving emicizumab prophylaxis. Haemophilia. 2019;25(5):789-796.

Baxevanis et al., Evidence for distinct epitopes on human IgG with T cell proliferative and suppressor function, Eur J Immunol., 1986, 16(8): 1013-1016.

Berntorp et al., Consensus perspectives on prophylactic therapy for haemophilia: summary statement, Haemophilia, 2003, 9(Suppl 1): 1-4.

Berntorp et al., Modern treatment of haemophilia, Bull World Health Organ., 1995, 73(5): 691-701.

Blanchette et al., Plasma and albumin-free recombinant factor VIII: pharmacokinetics, efficacy, and safety in previously treated pediatric patients. J Thromb Haemost. 2008;6(8):1319-26.

Blanchette et al., Definitions in hemophilia: communication from the SSC of the ISTH, J Thromb Haemost., 2014, 12(11): 1935-1939.

Blumberg RS, Lillicrap D. Tolerogenic properties of the Fc portion of IgG and its relevance to the treatment and management of hemophilia. Blood. 2018;131(20):2205-2214.

Borel et al., Prevention of Murine Lupus Nephritis by Carrier-Dependent Induction of Immunologic Tolerance to Denatured DNA, Science, 1973, 182(4107): 76-78.

Byetta United States Prescribing Information [USPI], Feb. 2015, AstraZeneca Pharmaceuticals LP. The most recent version is available at: https://www.azpicentral.com/byetta/pi_byetta.pdf.

Carcao M, et al., Recombinant factor VIII Fc fusion protein for immune tolerance induction in patients with severe haemophilia A with inhibitors-A retrospective analysis, Haemophilia, 2018, 24(2): 245-252.

Carcao M, Goudemand J. Inhibitors in Hemophilia: a primer. 5 ed: World Federation of Hemophilia; 2018.

Carpenter SL, Michael Soucie J, Sterner S, et al. Increased prevalence of inhibitors in Hispanic patients with severe haemophilia A enrolled in the Universal Data Collection database. Haemophilia. 2012;18(3):e260-5.

Chamow at al., Immunoadhesins: principles and applications, Trends Biotechnol., 1996, 14(2): 52-60.

Chhabra et al., Application of in silico antigenicity prediction methods to avoid neo-epitopes during the designing of BIIB073, a next-generation long-acting recombinant Factor VIII (rFVIII) molecule, Haemophilia, 2016, 22(Suppl 4): 18.

Collins et al., Factor VIII requirement to maintain a target plasma level in the prophylactic treatment of severe hemophilia A: influences of variance in pharmacokinetics and treatment regimens, J Thromb Haemost., 2009, 8(2): 269-275.

Coyle et al., Phase 1 study of BAY 94-9027, a PEGylated B-domain—deleted recombinant factor VIII with an extended half-life, in subjects with hemophilia A, J Thromb Haemost., 2014, 12(4): 488-496.

Darby et al., The incidence of factor VIII and factor IX inhibitors in the hemophilia population of the UK and their effect on subsequent mortality, 1977-99, J Thromb Haemost., 2004, 2(7): 1047-1054.

De Groot et al., Activation of natural regulatory T cells by IgG Fc-derived peptide "Tregitopes", Blood, 2008, 112: 3303-3311.

Ding et al., Multivalent antiviral XTEN-peptide conjugates with long in vivo half-life and enhanced solubility, Bioconjugate Chem., 2014, 25: 1351-1359.

Dumont et al., Prolonged activity of a recombinant factor VIII-Fc fusion protein in hemophilia A mice and dogs, Blood, 2012, 119(13): 3024-3030.

Dumont, The Evolving Science of Fc Fusion Proteins for the Treatment of Hemophilia, 2nd Fc Receptor & IgG Targeted Therapies Summit, Apr. 27, 2022, Boston, MA.

Eloctate United States Prescribing Information [USPI], Jan. 2017, Biogen Inc., The most recent version is available at: https://www.eloctate.com/pdfs/full-prescribing-information.pdf.

European Medicines Agency (EMA), Committee for Medicinal Products for Human Use (CHMP), Guideline on the clinical investigation of recombinant and human plasma-derived factor VIII products, London, Jul. 21, 2011., EMA/CHMP/BPWP/144533/2009 rev. 1, Available from: http://www.ema.europa.eu/docs/en_GB/document_library/Scientificguideline/2011/08/WC500109692.pdf.

European Medicines Agency. Elocta (rFVIIIFc) Summary of Product Characteristics. https://www.ema.europa.eu/en/ documents/product-information/elocta-epar-product-information_ en.pdf. Published 2019. Accessed May 2020.

Fraternale et al., Polarization and Repolarization of Macrophages, J Clin Cell Immunol, 2015, 6(2): 1-10.

Gouw et al., Treatment characteristics and the risk of inhibitor development: a multicenter cohort study among previously untreated patients with severe hemophilia A, J Thromb Haemost., 2007, 5(7): 1383-1390.

Graw et al., Haemophilia A: from mutation analysis to new therapies, Nat Rev Genet. 2005, 6(6): 488-501.

Groomes CL, et al. Reduction of Factor VIII Inhibitor Titers During Immune Tolerance Induction With Recombinant Factor VIII-Fc Fusion Protein. Pediatr Blood Cancer. 2016;63(5): 922-924.

Hay CR, et al. The principal results of the International Immune Tolerance Study: a randomized dose comparison. Blood. 2012:119(6):1335-1344.

Hermans C, et al. Recombinant factor VIII Fc for the treatment of haemophilia A. Eur J Haematot 2021;106(6):745-761.

Hermans et al., Pharmacokinetics in routine haemophilia clinical practice: rationale and modalities—a practical review, Therapeutic Advances in Hematology, 2020, 11: 1-15.

Irani et al., Molecular properties of human IgG subclasses and their implications for designing therapeutic monoclonal antibodies against infectious diseases, Mol Immunol., 2015, 67: 171-182.

Janbain M, Pipe S. What is the role of an extended half-life product in immune tolerance induction in a patient with severe hemophilia A and high-titer inhibitors? Hematology Am Soc Hematol Educ Program. 2016;2016(1):648-649.

Jazayeri et al., Half-Life Extension by Fusion to the Fc Region, Therapeutic Proteins: Strategies to Modulate Their Plasma Half-Live, Wiley-VCH Verlag Gmbh & Co., KGaA, 2012, pp. 157-188.

Kis-Toth K, et al. Recombinant factor VIII Fc fusion protein drives regulatory macrophage polarization. Blood Adv. 2018;2(21):2904-2916.

Kis-Toth, et al., Recombinant Factor Viii Fc Fusion Protein Exhibits Immunomodulatory Effects on Antigen-Presenting Cells, 9th BIC Int'l Conference Presentation, 2017.

Konigs C, et al. Final results of Pups A-Long study: evaluating safety and efficacy of rFVIIIFc in previously untreated patients with haemophilia A. Res Pract Thromb Haemost. 2020;4 S1:8 (Abstract OC 03.02).

Konigs C, et al. Final Results of ReITIrate—A Prospective Study of Rescue Immune Tolerance Induction (ITI) with Recombinant Factor VIII Fc (rFVIIIFc) in Patients Who Have Failed Previous ITI Attempts. Poster PB0522 presented at the International Society on Thrombosis and Haemostasis (ISTH) 2021 Virtual Congress, Jul. 17-21, 2021, Philadelphia, PA, USA.

Konkle et al., Pegylated, full-length, recombinant factor VIII for prophylactic and on-demand treatment of severe hemophilia A, Blood, 2015, 126(9): 1078-1085.

Krishnamoorthy et al., Recombinant factor VIII Fc (rFVIIIFc) fusion protein reduces immunogenicity and induces tolerance in hemophilia A mice, Cell Immunol., 2016, 301: 30-39.

Kronek et al., Biocompatibility and Immunocompatibility Assessment of Poly(2-Oxazolines), in Andrade et al. eds Practical Applications in Biomedical Engineering 2013.

Kulkarni R, et al. Improved hemostasis and joint health over time in a subset of patients who did not reach optimal hemostatic control in the first year of recombinant factor VIII Fc fusion protein (rFVIIIFc) therapy. Research and Practice in Thrombosis and Haemostasis. 2019;3(S1):262.

(56) References Cited

OTHER PUBLICATIONS

LaCroix-Desmazes et al., Fc-fusion technology beyond half-life extension—review of potential immunomodulatory and anti-inflammatory effects of rFVIIIFc in haemophilia A, WFH 2022 World Congress, Montreal and virtual, May 8-11, 2022.
Lee et al., Utilization patterns of coagulation factor consumption for patients with hemophilia, J Korean Med Sci., 2010, 31(1): 33-38.
Lee NK, et al. A crucial role for reactive oxygen species in RANKL-induced osteoclast differentiation. Blood. 2005;106(3):852-859.
Lei et al., Induction of tolerance to factor VIII inhibitors by gene therapy with immunodominant A2 and C2 domains presented by B cells as Ig fusion proteins, Blood, 2005, 105(12): 4865-4870.
Lenting et al., Von Willebrand factor interaction with FVIII: development of long-acting FVIII therapies, Blood, 2016, 128: SCI-8.
Mahlangu J, et al. Phase 3 study of recombinant factor VIII Fc fusion protein in severe hemophilia A. Blood. 2014;123(3): 317-325.
Malec LM, et al. Extended half-life factor VIII for immune tolerance induction in haemophilia. Haemophilia. 2016;22(6):e552-e554.
Manco-Johnson et al., Prophylaxis versus episodic treatment to prevent joint disease in boys with severe hemophilia, N Engl J Med., 2007, 357(6): 535-544.
Meeks et al., Emerging benefits of Fc fusion technology in the context of recombinant factor VIII replacement therapy, Haemophilia, 2020, 26(6): 958-965.
Mi et al., Targeting the Neonatal Fc Receptor for Antigen Delivery Using Engineered Fc Fragments, J Immunol., 2008, 181(11): 7550-7561.
Moore et al., A Randomized Safety and Efficacy Study of Somavaratan (VRS-317), a Long-Acting rhGH, in Pediatric Growth Hormone Deficiency, J Clin Endocrinol Metab., 2016, 101(3): 1091-1097.
Nagao A, et al., PB0277 Real-world Data of Immune Tolerance Induction Using Recombinant Factor VIII Fc Fusion Protein for Hemophilia A Patients with Inhibitors in Japan: Observational Fc Adolescent and Children Treatment Study (FACTs) First Interim Reports, Res Pract Thromb Haemost., 2019, 3(S1): 290.
National Hemophilia Foundation (NHF). Medical and Scientific Advisory Council (MASAC). MASAC Document #241: MASAC Recommendation Concerning Prophylaxis, Feb. 28, 2016.
Nilsson et al., Twenty-five years' experience of prophylactic treatment in severe haemophilia A and B, J Intern Med., 1992, 232(1): 25-32.
Nimmerjahn et al., Fcgamma receptors as regulators of immune responses, Nat Rev Immunol., 2008, 8(1): 34-47.
Nimmerjahn F., Molecular and Cellular Pathways of Immunoglobulin G Activity In Vivo, ISRN Immunology, 2014, Article ID 524081.
Nolan B, et al. Recombinant factor VIII Fc fusion protein for the treatment of severe haemophilia A: final results from the ASPIRE extension study. Haemophilia 2020:26(3):494-502.
Oldenburg J, et al. Improved joint health in subjects with severe haemophilia A treated prophylactically with recombinant factor VIII Fc fusion protein. Haemophilia. 2018:24(1):77-84.
Pasi J HC, et al. Improvement in pain-related quality of life in patients with hemophilia A treated with FFVIIIFc individualized prophylaxis: post hoc analysis from the A-LONG study. Therapeutic Advances in Hematology. 2022.
Peters RT, et al., Prolonged activity of factor IX as a monomeric Fc fusion protein, Blood, 2010, 115(10): 2057-2064.
Peters RT, et al., Biochemical and functional characterization of a recombinant monomeric factor VIII-Fc fusion protein, J Thromb Haemost., 2013, 11(1): 132-141.
Pipe et al., Life in the shadow of a dominant partner: the FVIII-VWF association and its clinical implications for hemophilia A, Blood, 2016, 128(16): 2007-2016.
Podust VN, et al. Extension of in vivo half-life of biologically active molecules by XTEN protein polymers. J Control Release. 2016; 240:52-66.
Powell JS, et al., Safety and prolonged activity of recombinant factor VIII Fc fusion protein in hemophilia A patients, Blood, 2012, 119(13): 3031-3037.
Powell JS, et al., Phase 3 Study of Recombinant Factor IX Fc Fusion Protein in Hemophilia B, N Engl J Med., 2013, 369(24): 2313-2323.
Rajani G, et al., OC 75.5 Recombinant Factor VIII Fc Fusion Protein Inhibits Inflammatory Osteoclast Formation in vitro, Research and Practice in Thrombosis and Haemostasis, 2019, 3(S1): 126.
Rath T, et al., Fc-fusion proteins and FcRn: structural insights for longer-lasting and more effective therapeutics, Crit Rev Biotechnol., 2015, 35(2): 235-254.
Roopenian et al., FcRn: the neonatal Fc receptor comes of age, Nat Rev Immunol., 2007, 7(9): 715-725.
Roosendaal et al., Blood-induced joint damage in hemophilia, Semin Thromb Haemost., 2003, 29(1): 37-42.
Saenko et al., A mechanism of inhibition of factor VIII binding to phospholipid by von Willebrand factor, J Biol Chem, 1995, 270(23): 13826-13833.
Sanofi, "FDA grants efanesoctocog alfa Breakthrough Therapy designation for hemophilia A", Press Release, Jun. 1, 2022.
Saqib U, et al. Phytochemicals as modulators of M1-M2 macrophages in inflammation. Oncotarget. 2018;9(25): 17937-17950.
Schellenberger et al., A recombinant polypeptide extends the in vivo half-life of peptides and proteins in a tunable manner, Nat Biotechnol., 2009, 27(12): 1186-1190.
Schwab et al., Intravenous immunoglobulin therapy: how does IgG modulate the immune system?, Nat Rev Immunol., 2013, 13(3): 176-189.
Scott DW, Pratt KR Factor VIII: Perspectives on Immunogenicity and Tolerogenic Strategies. Front Immunol. 2020, 10: 3078.
Shapiro et al., Recombinant factor IX-Fc fusion protein (rFIXFc) demonstrates safety and prolonged activity in a phase 1/2a study in hemophilia B patients, Blood, 2012, 119(3): 666-672.
Skinner, WFH: closing the global gap—achieving optimal care, Haemophilia, 2012, 18(Suppl 4): 1-12.
Srivastava et al., WFH Guidelines for the Management of Hemophilia, 3rd edition, Haemophilia. 2020, 26 Suppl 6: 1-158.
Srivastava et al., Treatment Guidelines Working Group on behalf of the World Federation of Hemophilia, Guidelines for the management of hemophilia, Haemophilia, 2013, 19(1): e1-47.
Strohl WR. Fusion Proteins for Half-Life Extension of Biologics as a Strategy to Make Biobetters. BioDrugs. 2015;29(4): 215-239.
Tiede et al., Enhancing the pharmacokinetic properties of recombinant factor VIII: first-in-human trial of glycoPEGylated recombinant factor VIII in patients with hemophilia A, J Thromb Haemost., 2013, 11(4): 670-678.
Toby et al., Recombinant Factor IX Fc Fusion Protein Maintains Full Procoagulant Properties and Exhibits Prolonged Efficacy in Hemophilia B Mice, PLoS One, 2016, 11(2): e0148255.
United Kingdom Haemophilia Centre Doctors' Organisation (UKHCDO), UKHCDO Bleeding Disorder Statistics for 2010-2011, a report from the National Haemophila Database, 2011, Available at: http://www.ukhcdo.org/docs/AnnualReports/2011/LTKHCDO%20Bleeding%20Disorder%20Statistics%20for%202010-2011.pdf.
Viel et al., Inhibitors of factor VIII in black patients with hemophilia, N Engl J Med., 2009, 360(16): 1618-1627.
White et al., A multicenter study of recombinant factor VIII (Recombinate) in previously treated patients with hemophilia A, The Recombinate Previously Treated Patient Study Group, Thromb Haemost., 1997, 77(4): 660-667.
Witmer C, Young G. Factor VIII inhibitors in hemophilia A: rationale and latest evidence. TherAdv Hematol., 2013;4(1): 59-72.
Witmer et al., Associations between intracranial haemorrhage and prescribed prophylaxis in a large cohort of haemophilia patients in the United States, Br J Haematol., 2011, 152(2): 211-216.
World Federation of Haemophilia (WFH), World Federation of Hemophilia Report on the Annual Global Survey 2010, Montreal, Quebec: World Federation of Hemophilia, Dec. 2011.
World Health Organization (WHO), WHO Handbook for Reporting Results of Cancer Treatment, Geneva, 1979, Available at: http://apps.who.int/iris/bitstream/10665/37200/1/WHO_OFFSET_48.pdf.

(56) References Cited

OTHER PUBLICATIONS

Wu et al., Pharmacokinetics of Peptide-Fc fusion proteins, J Pharm Sci., 2014, 103(1): 53-64.
Yee et al., A von Willebrand factor fragment containing the D'D3 domains is sufficient to stabilize coagulation factor VIII in mice, Blood, 2014, 124(3): 445-452.
Young G, et al. Recombinant factor VIII Fc fusion protein for the prevention and treatment of bleeding in children with severe hemophilia A. J Thromb Haemost. 2015;13(6):967-977.
Yuen et al., A long-acting human growth hormone with delayed clearance (VRS-317): results of a double-blind, placebo-controlled, single-ascending dose study in growth hormone-deficient adults, J Clin Endocrinol Metab., 2013, 98(6): 2595-2603.
Zambidis et al., Epitope-specific tolerance induction with an engineered immunoglobulin, Proc Natl Acad Sci USA. 1996; 93(10): 5019-5024.
Zhou JY, et al. Joint Bleeding Tendencies in Adult Patients With Hemophilia: It's Not All Pharmacokinetics. Clin Appl Thromb Hemost., 2019;25:1076029619862052.
U.S. Appl. No. 13/513,424, filed Dec. 28, 2012, Publ'n No. 2013/0108629, Publ'n Date May 2, 2013, U.S Pat. No. 9,050,318, Grant Date Jun. 9, 2015, Jennifer A. Dumont, Factor VIII—FC Chimeric and Hybrid Polypeptides, and Methods of Use Thereof.
U.S. Appl. No. 13/793,783, filed Mar. 11, 2013, Publ'n No. 2013/0274194, Publ'n Date Oct. 17, 2013, U.S Pat. No. 9,241,971 Grant Date Jan. 26, 2016, Jennifer A. Dumont, Factor VIII—FC Chimeric and Hybrid Polypeptides, and Methods of Use Thereof.
U.S. Appl. No. 16/270,302, filed Feb. 7, 2019, Publ'n No. 2019/0262429, Publ'n Date Aug. 29, 2019, U.S Pat. No. 11,266,720, Grant Date Mar. 8, 2022, Jennifer A. Dumont, Factor VIII—FC Chimeric and Hybrid Polypeptides, and Methods of Use Thereof.
U.S. Appl. No. 17/587,941, filed Jan. 28, 2022, Publ'n No. 2022/0265780, Publ'n Date Aug. 25, 2022, Jennifer A. Dumont, Factor VIII—FC Chimeric and Hybrid Polypeptides, and Methods of Use Thereof.
U.S. Appl. No. 13/365,166, filed Aug. 19, 2011, Publ'n No. 2013/0017997, Publ'n Date Jan. 17,2013, Volker Schellen-Berger, Factor VIII Compositions and Methods of Making and Using Same.
U.S. Appl. No. 13/423,031, filed Aug. 19, 2011, Publ'n No. 2012/0178691, Publ'n Date Jul. 12, 2012, Volker Schellen-Berger, Factor VIII Compositions and Methods of Making and Using Same.
U.S. Appl. No. 14/317,888, filed Aug. 19, 2011, Publ'n No. 2015/0038421, Publ'n Date Feb. 5, 2015, Volker Schellen-Berger, Factor VIII Compositions and Methods of Making and Using Same.
U.S. Appl. No. 15/163,561, filed Aug. 19, 2011, Publ'n No. 2016/0376344, Publ'n Date Dec. 29, 2016, Volker Schellen-Berger, Factor VIII Compositions and Methods of Making and Using Same.
U.S. Appl. No. 16/369,820, filed Mar. 29, 2019, Publ'n No. 2019/0315835, Publ'n Date Oct. 17, 2019, Volker Schellen-Berger, Factor VIII Compositions and Methods of Making and Using Same.
U.S. Appl. No. 17/097,978, filed Nov. 13, 2020, Volker Schellen-Berger, Factor VIII Compositions and Methods of Making and Using Same.
U.S. Appl. No. 17/240,351, filed Apr. 26, 2021, Publ'n No. 2023/0019286, Publ'n Date Jan. 19, 2023, Volker Schellen-Berger, Factor VIII Compositions and Methods of Making and Using Same.
U.S. Appl. No. 14/371,948, filed Jul. 11, 2014, Publ'n No. 2015/0023959, Publ'n Date Jan. 22, 2015, Ekta Seth Chhabra, Chimeric Factor VIII Polypeptides and Uses Thereof.
U.S. Appl. No. 16/357,189, filed Mar. 18, 2019, Ekta Seth Chhabra, Chimeric Factor VIII Polypeptides and Uses Thereof.
U.S. Appl. No. 17/826,932, filed May 27, 2022, Publ'n No. 2023/0011438, Publ'n Date May, 27, 2022, Ekta Seth Chhabra, Chimeric Factor VIII Polypeptides and Uses Thereof.
U.S. Appl. No. 14/379,192, filed Feb. 20, 2015, Publ'n No. 2015/0158929, Publ'n Date Jun. 11, 2015, U.S. Pat. No. 10,421,798, Grant Date Sep. 24, 2019, Volker Schellen-Berger, Factor VIII Compositions and Methods of Making and Using Same.
U.S. Appl. No. 16/521,789, filed Jul. 25, 2019, Publ'n No. 2020/0087379, Publ'n Date Mar. 19, 2020, Volker Schellen-Berger, Factor VIII Compositions and Methods of Making and Using Same.
U.S. Appl. No. 18/064,571, filed Dec. 12, 2022, Volker Schellen-Berger, Factor VIII Compositions and Methods of Making and Using Same.
U.S. Appl. No. 14/413,765, filed Jan. 9, 2015, Publ'n No. 2015/0266943, Publ'n Date Sep. 24, 2015, U.S. Pat. No. 10,138,291, Grant Date Nov. 27, 2018, Ekta Seth Chhabra, Factor VIII Complex with XTEN and Von Williebrand Factor Protein, and Uses Thereof.
U.S. Appl. No. 16/154,310, filed Oct. 8, 2018, Publ'n No. 2019/0169267, Publ'n Date Jun. 6, 2019, U.S. Pat. No. 11,091,534, Grant Date Aug. 17, 2021, Ekta Seth Chhabra, Factor VIII Complex with XTEN and Von Williebrand Factor Protein, and Uses Thereof.
U.S. Appl. No. 17/358,142, filed Jun. 25, 2021, Publ'n No. 2022/0056108, Publ'n Date Feb. 24, 2022, Ekta Seth Chhabra, Factor VIII Complex with XTEN and Von Williebrand Factor Protein, and Uses Thereof.
U.S. Appl. No. 14/895,264, filed Dec. 2, 2015, Publ'n No. 2016/0229903, Publ'n Date Aug. 11, 2016, Ekta Seth Chhabra, Thrombin Cleavable Linker.
U.S. Appl. No. 14/894,108, filed May 3, 2016, Publ'n No. 2016/0261408, Publ'n Date Sep. 1, 2016, Ekta Seth Chhabra, Thrombin Cleavable Linker with XTEN and its Uses Thereof.
U.S. Appl. No. 17/479,705, filed Sep. 20, 2021, Publ'n No. 2022/0106383, Publ'n Date Apr. 7, 2022, Ekta Seth Chhabra, Thrombin Cleavable Linker with XTEN and its Uses Thereof.
U.S. Appl. No. 18/358,601, filed Jul. 25, 2023, Ekta Seth Chhabra, Thrombin Cleavable Linker with XTEN and its Uses Thereof.
(Dec. 12, 2014) "Approval Letter—NovoSeven", U.S. Food and Drug Administration, Department of Health and Human Services, FDA Reference No. 96-0597, accessed at http://www.fda.gov/BiologicsBloodVaccines/BloodBloodProducts/ApprovedProducts/LicensedProductsBLAs/FractionatedPlasmaProducts/ucm056916.htm#, 2 Pages.
Abstracts, Haemophilia, Jul. 11, 2016, 22 (Suppl. 4): 3-138, Konkle et al. "Dosing regimens before and following long-term treatment with recombinant factor VIII Fc fusion protein (rFVIIIFc) in adults and adolescents with severe hemophilia A".
Ackerman, et al. (1997) "Ion Channels—Basic Science and Clinical Disease", the New England Journal of Medicine, vol. 336, No. 22, pp. 1575-1586.
Adams, et al. (1998) "Increased Affinity Leads to Improved Selective Tumor Delivery of Single-Chain Fv Antibodies", Cancer Research, vol. 58, No. 3, pp. 485-490.
Adams, et al. (2001) "High Affinity Restricts the Localization and Tumor Penetration of Single-Chain Fv Antibody Molecules", Cancer Research, vol. 61, No. 12, pp. 4750-4755.
Ahmad, et al. (May 1, 2004) "ASA View: Database and tool for Solvent Accessibility Representation in Proteins", BMC Bioinformatics, vol. 5, No. 51, pp. 1-5.
Alam, et al. (1998) "Expression and Purification of a Mutant Human Growth Hormone That Is Resistant to Proteolytic Cleavage by Thrombin, Plasmin and Human Plasma In Vitro", Journal of Biotechnology, vol. 65, No. 2-3, Elsevier Science Publishers, Netherlands, pp. 183-190.
Alber, et al. (1982) "Nucleotide Sequence of the Triose Phosphate Isomerase Gene of Saccharomyces Cerevisiae", Journal of Molecular and Applied Genetics, vol. 1.5, pp. 419-434.
Algiman, et al. (1992) "Natural Antibodies to Factor VIII (Anti-Hemophilic Factor) In Healthy Individuals", Proceedings of the National Academy of Sciences, vol. 89, No. 9, pp. 3795-3799.
Altuviiio [package insert], Waltham, MA: Bioverativ Therapeutics Inc., 2023.
Amin, et al. (2004) "Construction of Stabilized Proteins by Combinatorial Consensus Mutagenesis", Protein Engineering, Design & Selection: PEDS, vol. 17, No. 11, pp. 787-793.
Amunix, "Bioverativ announces FDA acceptance of IND Application for BIVV001 a novel, long-acting FVIII hemophilia therapeutic utilizing Amunix XTEN® half-life extension technology", Jun. 14, 2017, retrieved from: https://www.amunix.com/newsroom/press-releases/2017/061417, 2 pages.

(56) References Cited

OTHER PUBLICATIONS

Amy et al., Hemophilia A, in Transfusion Medicine and Hemostasis (2nd Ed.) 2013, Clinical and Laboratory Aspects, Chapter 106, pp. 699-704.
Ansong, et al. (2006) "Epitope Mapping Factor VIII A2 Domain by Affinity-Directed Mass Spectrometry: Residues 497-510 and 584-593 Comprise a Discontinuous Epitope for the Monoclonal Antibody R8B 12", Journal of Thrombosis and Haemostasis, vol. 4, No. 4, pp. 842-847.
Antcheva (2001) "Proteins of Circularly Permuted Sequence Present within the Same Organism: The Major Serine Proteinase inhibitor from Capsicum Annuum Seeds", Protein Science, vol. 10, No. 11, pp. 2280-2290.
Appa, R, et al. (Aug. 2010) "Investigating Clearance Mechanisms for Recombinant Activated Factor VII in a Perfused Liver Model", Journal of Thrombosis and Haemostasis, vol. 104, No. 2, pp. 243-251.
Araki, et al. (1990) "Four Disulfide Bonds' Allocation of Na+, K+-ATPase Inhibitor (SPAI)", Biochemical and Biophysical Research Communications, vol. 172, No. 1, pp. 42-46.
Arap, et al. (2002) "Steps Toward Mapping the Human Vasculature by Phage Display", Nature Medicine, vol. 8, No. 2, pp. 121-127.
Arndt, et al. (1998) "Factors Influencing the Dimer to Monomer Transition of an Antibody Single-Chain Fv Fragment", Biochemistry, vol. 37, pp. 12918-12926.
Arruda, et al. (Jan. 1, 2001) "Posttranslational Modifications of Recombinant Myotube-Synthesized Human Factor Ix", Blood, vol. 97, No. 1, pp. 130-138.
Assadi-Porter, et al. (2000) "Sweetness Determinant Sites of Brazzein, a Small, Heat-Stable, Sweet-Tasting Protein", Archives of Biochemistry and Biophysics, vol. 376, No. 2, pp. 259-265.
Aster, et al. (Apr. 13, 1999) "the Folding and Structural Integrity of the First LIN-12 Module of Human Notch1 Are Calcium-Dependent", Biochemistry, vol. 38, No. 15, pp. 4736-4742.
Bachmann, et al. (1995) "T Helper Cell-Independent Neutralizing B Cell Response Against Vesicular Stomatitis Virus: Role of Antigen Patterns in B Cell Induction", European Journal of Immunology, vol. 25, No. 12, pp. 3445-3451.
Bailon, et al. (2001) "Rational Design of a Potent, Long-Lasting form of Interferon: a 40 kDa Branched Polyethylene Glycol-Conjugated Interferon α-2a for the Treatment of Hepatitis C", Bioconjugate Chemistry, vol. 12, No. 2, pp. 195-202.
Bajaj, et al. (1993) "Human Factor IX and Factor IXa", Methods in Enzymology, vol. 222, pp. 96-128.
Baneyx, et al. (2004) "Recombinant Protein Folding and Misfolding in *Escherichia Coli*", Nature Biotechnology, vol. 22, No. 11, pp. 1399-1408.
Baron, et al. (1990) "From Cloning to a Commercial Realization: Human Alpha Interferon", Critical Reviews in Biotechnology, vol. 10, No. 3, pp. 179-190.
Barrowcliffe, et al. (Jun. 2002) "Coagulation and Chromogenic Assays of Factor VIII Activity: General Aspects, Standardization, and Recommendations", Seminars in Thrombosis and Hemostasis, vol. 28, No. 3, pp. 247-256.
Barta, et al. (2002) "Repeats with Variations: Accelerated Evolution of the Pin2 Family of Proteinase Inhibitors", TRENDS in Genetics, vol. 18, No. 12, pp. 600-603.
Baskin et al., Management of occlusion and thrombosis associated with longterm indwelling central venous catheters, Lancet. 2009, 374(9684): 159-169.
Bateman, et al. (1998) "Granulins: The Structure and Function of An Emerging Family of Growth Factors,", the Journal of Endocrinology, vol. 158, No. 2, pp. 145-151.
Batorova et al., "Expert opinion on current and future prophylaxis therapies aimed at improving protection for people with hemophilia A", Journal of Medicine and Life, Apr. 4, 2022, 15(4): 570-578.
Beissinger, et al. (1998) "How Chaperones Fold Proteins", Biological Chemistry, vol. 379, No. 3, pp. 245-259.

Belaaouaj, et al. (2000) "Matrix Metalloproteinases Cleave Tissue Factor Pathway Inhibitor Effects on Coagulation", Journal of Biological Chemistry, vol. 275, No. 35, p. 27123-27128.
Belew, et al. (1994) "Purification of Recombinant Human Granulocyte-Macrophage Colony-Stimulating Factor from the Inclusion Bodies Produced by Transformed *Escherichia Coli* Cells", Journal of Chromatography A, vol. 679, No. 1, pp. 67-83.
Benhar, et al. (Dec. 1994) "Cloning, Expression and Characterization of the Fv Fragments of the Anti-Carbohydrate mAbs B1 and B5 As Single-Chain Immunotoxins", Protein Engineering, Design and Selection, vol. 7, No. 12, pp. 1509-1515.
Bensch, et al. (1995) "Hbd-1: A Novel Beta-Defensin from Human Plasma", FEBS Letters, vol. 368, No. 2, pp. 331-335.
Berger, et al. (1993) "Phoenix Mutagenesis: one-Step Reassembly of Multiply Cleaved Plasmids with Mixtures of Mutant and Wild-Type Fragments", Analytical Biochemistry, vol. 214, No. 2, pp. 571-579.
Beste, et al. (1999) "Small Antibody-like Proteins with Prescribed Ligand Specificities Derived from the Lipocalin Fold", Proceedings of the National Academy of Sciences, vol. 96, No. 5, pp. 1898-1903.
Bhagunde et al., "A Population Pharmacokinetic (PopPK) Model to Characterize Efanesoctocog Alfa (BIVV001) Factor VIII (FVIII) Activity Levels in Patients With Severe Hemophilia A", Abstract, HTRS Mar. 10-12, 2023, Orlando, Florida.
Bhagunde et al., "A Population Pharmacokinetic (PopPK) Model to Characterize Efanesoctocog Alfa (BIVV001) Factor VIII (FVIII) Activity Levels in Patients with Severe Hemophilia A", Abstract, Blood, Nov. 15, 2022, 140 (Supplement 1): 8449-8450.
Bhagunde et al., "A Population Pharmacokinetic (PopPK) Model to Characterize Efanesoctocog Alfa (BIVV001) Factor VIII (FVIII) Activity Levels in Patients with Severe Hemophilia A", Poster, Blood, Nov. 15, 2022.
Bhagunde et al., "A Repeated Time to Event (RTTE) Model to Characterize Bleed Risk in Patients with Severe Hemophilia A Treated with Efanesoctocog Alfa", Abstract, Haemophilia, 2023.
Bhagunde et al., "A Repeated Time to Event (RTTE) Model to Characterize Bleed Risk in Patients with Severe Hemophilia A Treated with Efanesoctocog Alfa", Poster, 16th Annual Congress of the European Association for Haemophilia and Allied Disorders, Feb. 7-10, 2023.
Bhagunde et al., "A Population Pharmacokinetic (PopPK) Model to Characterize Efanesoctocog Alfa (BIVV001) Factor VIII (FVIII) Activity Levels in Patients With Severe Hemophilia", Poster, HTRS Mar. 10-12, 2023, Orlando, Florida.
Bharmal et al., Validation of an abbreviated Treatment Satisfaction Questionnaire for Medication (TSQM-9) among patients on antihypertensive medications, 2009, Health Qual Life Outcomes, 7: 36.
Bihoreau et al., "Structural and functional characterization of Factor VIII-ΔII, a new recombinant Factor VIII lacking most of the B-domain", Biochem. J. vol. 277, 1991, pp. 23-31.
Binz, et al. (2005) "Engineering Novel Binding Proteins from Nonimmunoglobulin Domains", Nature Biotechnology, vol. 23, No. 10, pp. 1257-1268.
Bioverativ Investor Day, Jan. 6, 2017.
Bioverativ, Summary Basis for Regulatory Action of ALTUVIIIO, Feb. 21, 2023.
Bird, et al. (Oct. 21, 1988) "Single-Chain Antigen-Binding Proteins", Science, vol. 242, No. 4877, pp. 423-426.
Bittner, et al. (1998) "Recombinant Human Erythropoietin (rhEPO) Loaded Poly (Lactide-Co-Glycolide) Microspheres: influence of the Encapsulation Technique and Polymer Purity on Micro Sphere Characteristics", European Journal of Pharmaceutics and Biopharmaceutics vol. 45, No. 3, pp. 295-305.
Bjoern, S., et al. (Sep. 1986) "Activation of Coagulation Factor VII to VIIa", Research Disclosure, vol. 269, pp. 564-565.
Bjorkman, et al. (Nov. 1, 2001) "Pharmacokinetics of Coagulation Factors: Clinical Relevance for Patients with Haemophilia", Clinical Pharmacokinetics, vol. 40, No. 11, Adis International Ltd., New Zealand, pp. 815-832.
Blanchette et al., "For the Subcommittee on Factor VIII, Factor IX, and Rare Coagulation Disorders. Definitions in hemophilia: communication from the SSC of the IST", J Thromb Haemost. 2014; 12(11):1935-9.

(56) References Cited

OTHER PUBLICATIONS

Blanchette, et al. (2004) "Principles of Transmucosal Delivery of therapeutic Agents", Biomedicine & Pharmacotherapy, vol. 58, No. 3, pp. 142-151.
Bloch, et al. (1998) "1H NMR Structure of An Antifungal Gannna-Thionin Protein Sialpha1: Similarity to Scorpion toxins", Proteins, vol. 32, No. 3, pp. 334-349.
Bobrow, R. S. (2005) "Excess Factor VIII: A Common Cause of Hypercoagulability", American Board of Family Medicine, United States, pp. 147-149.
Bodenmuller, et al. (1986) "the Neuropeptide Head Activator Loses Its Biological Acitivity by Dimerization", the EMBO Journal vol. 5, No. 8, pp. 1825-1829.
Boder, et al. (Sep. 26, 2000) "Directed Evolution of Antibody Fragments with Monovalent Femtomolar Antigen-Binding Affinity", Proceedings of the National Academy of Sciences, vol. 97, No. 20, pp. 10701-10705.
Boshart, et al. (1985) "A Very Strong Enhancer Is Located Upstream of An Immediate Early Gene of Human Cytomegalovirus", Cell, vol. 41, No. 2, pp. 521-530.
Bovenschen (2010) "LDL Receptor Polymorphisms Revisited", Blood, vol. 116, No. 25, pp. 5439-5440.
Briet, et al. (1994) "High Titer Inhibitors in Severe Haemophilia A: A Meta-Analysis Based on Eight Long-term Follow-up Studies concerning Inhibitors Associated with Crude or Intermediate Purity Factor VIII Products", Journal of Thrombosis and Haemostasis, vol. 72, No. 1, pp. 162-164.
Brooks, et al. (Oct. 2002) "Evolution of Amino Acid Frequencies in Proteins Over Deep Time: Inferred order of Introduction of Amino Acids into the Genetic Code", Molecular Biology and Evolution, vol. 19, No. 10, pp. 1645-1655.
Buchner, J. (1996) "Supervising the Fold: Functional Principles of Molecular Chaperones", F ASEB Journal, vol. 10, No. 1, pp. 10-19.
Bulaj, et al. (2003) "Efficient Oxidative Folding of Conotoxins and the Radiation of Venomous Cone Snails", Proceedings of the National Academy of Sciences of the United States of America, vol. 100, Supplement 2, pp. 14562-14568.
Bullinger et al., Pilot testing of the 'Haemo-QoL' quality of life questionnaire for haemophiliac children in six European countries. Haemophilia, 2002, Mar. 8 Suppl 2: 47-54.
Buscaglia, et al. (1999) "Tandem Amino Acid Repeats from Trypanosoma Cruzi Shed Antigens Increase the Half-Life of Proteins in Blood", Blood, vol. 93, No. 6, pp. 2025-2032.
Calabrese, et al. (2004) "Crystal Structure of Phenylalanine Ammonia Lyase: Multiple Helix Dipoles Implicated in Catalysis", Biochemistry, vol. 43, No. 36, pp. 11403-11416.
Caliceti, et al. (2003) "Pharmacokinetic and Biodistribution Properties of Poly (Ethylene Glycol)—Protein Conjugates", Advanced Drug Delivery Reviews, vol. 55, No. 10, pp. 1261-1277.
Calvete, et al. (2000) "Disulphide-Bond Pattern and Molecular Modelling of the Dimeric Disintegrin Emf-10, A Potent and Selective integrin Alpha5Beta1 Antagonist from Eristocophis Macmahoni Venom", the Biochemical Journal, vol. 345, Part 3, pp. 573-581.
Calvete, et al. (2003) "Snake Venom Disintegrins: Novel Dimeric Disintegrins and Structural Diversification by Disulphide Bond Engineering", the Biochemical Journal, vol. 372, Part 3, pp. 725-734.
Calvete, et al. (2005) "Snake Venom Disintegrins: Evolution of Structure and Function", Toxicon, vol. 45, No. 8, pp. 1063-1074.
Cao, et al. (2006) "Development of a Compact Anti-Baff Antibody in *Escherichia Coli*", Applied Microbiology and Biotechnology, vol. 73, No. 1, pp. 151-157.
Carcao M, et al. Real-world data of immune tolerance induction using recombinant factor VIII Fc fusion protein in patients with severe haemophilia A with inhibitors at high risk for immune tolerance induction failure: A follow-up retrospective analysis. Haemophilia. 2020: 27(1):19-25.
Carcao M, et al. The changing face of immune tolerance induction in haemophilia A with the advent of emicizumab. Haemophilia. 2019:25(4):676-684.
Carlsson et al., "Pain, deperssion and anxiety in people with haemophilia from three Nordic countries: Cross-sectional survey data from the MIND study", Haemophilia, 2022, 28: 557-567.
Carlsson et al., On-demand vs. prophylactic treatment for severe haemophilia in Norway and Sweden: differences in treatment characteristics and outcome, Haemophilia, 2003,9(5): 555-566.
Carr, et al. (1994) "Solution Structure of a Trefoil-Motif-Containing Cell Growth Factor, Porcine Spasmolytic Protein", Proceedings of the National Academy of Sciences of the United States of America, vol. 91, No. 6, pp. 2206-2210.
Castor, et al. (1994) "Septic Cutaneous Lesions Caused by *Mycobacterium malmoense* in A Patient with Hairy Cell Leukemia", European Journal of Clinical Microbiology & infectious Diseases, vol. 13, No. 2, pp. 145-148.
Cella et al., The Patient-Reported Outcomes Measurement Information System (PROMIS): Progress of an NIH Roadmap Cooperative Group During Its First Two Years, Medical Care, 45(5 Suppl 1), 2007, S3-S11.
Centers for Disease Control and Prevention (CDC), Summary Report of UDC Activity National, Patient Demographics (Hemophilia) 2017. Available at: https://www2a.cdc.gov/ncbddd/htcweb/UDC_Report/UDC_Report.asp.
Chang, et al. (1978) "Phenotypic Expression in *E. coli* of A DNA Sequence Coding for Mouse Dihydrofolate Reductase", Nature, vol. 275, No. 5681, pp. 617-624.
Chen et al., "Fusion protein linkers: Property, design and functionality", Advanced Drug Delivery Reviews, Oct. 2013, 65(10): 1357-1369.
Chen, et al. (1991) "Crystal Structure of a Bovine Neurophysin li Dipeptide Complex at 2", Proceedings of the National Academy of Sciences of the United States of America vol. 88, No. 10, pp. 4240-4244.
Chen, et al. (1993) "Site-Directed Mutations in a Highly Conserved Region of Bacillus Thuringiensis Delta-Endotoxin Affect inhibition of Short Circuit Current Across Bombyx Mori Midguts", Proceedings of the National Academy of Sciences of the United States of America vol. 90, No. 19, pp. 9041-9045.
Chen, et al. (2006) "Expression, Purification, and in Vitro Refolding of a Humanized Single-Chain Fv Antibody Against Human Ctla4 (Cd152)", Protein Expression and Purification, vol. 46, No. 2, pp. 495-502.
Chhabra et al., "BIVV001, a new class of factor VIII replacement for hemophilia A that is independent of von Willebrand factor in primates and mice", Blood, Apr. 23, 2020, 135(17): 1484-1496.
Chirino, et al. (2004) "Minimizing the Immunogenicity of Protein therapeutics", Drug Discovery Today, vol. 9, No. 2, pp. 82-90.
Chong, et al. (2001) "Determination of Disulfide Bond assignments and NGlycosylation Sites of the Human Gastrointestinal Carcinoma Antigen Ga733-2 (Co17-1A, EGP, Ks1-4, KSA, and Ep-Cam)", The Journal of Biological Chemistry, vol. 276, No. 8, pp. 5804-5813.
Chong, et al. (2002) "Disulfide Bond Assignments of Secreted Frizzled-Related Protein-1 Provide Insights About Frizzled Homology and Netrin Modules", the Journal of Biological Chemistry, vol. 277, No. 7, pp. 5134-5144.
Choo, et al. (1982) "Molecular Cloning of the Gene for Human Anti-Haemophilic Factor IX", Nature, vol. 299, No. 5879, pp. 178-180.
Chou, et al. (1974) "Prediction of Protein Conformation", Biochemistry, vol. 13, No. 2, pp. 222-245.
Chowdary et al., "Managing surgery in hemophilia with recombinant factor VIII Fc and factor IX Fc: Data on safety and effectiveness from phase 3 pivotal studies", Res Pract Thromb Haemost., Jul. 2022, 6(5): E12760, 1-15.
Chowdhury, et al. (1999) "Improving Antibody Affinity by Mimicking Somatic Hypermutation In Vitro", Nature Biotechnology, vol. 17, No. 6, pp. 568-572.
Christmann, et al. (1999) "The Cystine Knot of a Squash-Type Protease Inhibitor as A Structural Scaffold for *Escherichia coli* Cell Surface Display of Conformationally Constrained Peptides", Protein Engineering, vol. 12, No. 9, pp. 797-806.
Clark, et al. (1996) "Long-Acting Growth Hormones Produced by Conjugation with Polyethylene Glycol", Journal of Biological Chemistry, vol. 271, No. 36, pp. 21969-21977.

(56) References Cited

OTHER PUBLICATIONS

Clark, et al. (1996) "Recombinant Human Growth Hormone (GH)-Binding Protein Enhances the Growth-Promoting Activity of Human GH in the Rat", Endocrinology, vol. 137, No. 10, pp. 4308-4315.
Cleland, et al. (2001) "Emerging Protein Delivery Methods", Current Opinion in Biotechnology, vol. 12, No. 2, pp. 212-219.
Cleland, et al. (2009) "An Extended Half-life Exenatide Construct for Weekly Administration in the Treatment of Diabetes Mellitus", Diabetes, vol. 58, pp. A511-A512.
Clinicaltrials.gov, (Apr. 13, 2018) Bioverativ Therapeutics, Inc., NCT03205163, Statistical Analysis Plan: Protocol Title: A Phase 1/2a, Open-Label, Dose-Escalation Study to Determine the Safety, Tolerability, and Pharmacokinetics of a Single Intravenous Injection of rFVIIIFc-VWF-XTEN (BIVV001) in Previously Treated Adults With Severe Hemophilia A, Protocol No. 242HA101, Version 1.0 dated Apr. 13, 2018, based on Protocol Version 6.0, dated Jan. 2, 2018.
Clinicaltrials.gov, (Apr. 7, 2023) "A Safety, Tolerability, and Pharmacokinetics Study of a Single Intravenous Injection of Recombinant Coagulation Factor VIII Fc-Von Willebrand Factor-XTEN Fusion Protein (rFVIIIFc-VWF-XTEN) (BIVV001) in Previously Treated Adults with Severe Hemophilia A (Exten-A)", Study Details, ClinicalTrials.gov Identifier: NCT03205163, https://clinicaltrials.gov/archive/NCT03205163.
Clinicaltrials.gov, (Apr. 7, 2023) "A Safety, Tolerability, and Pharmacokinetics Study of a Single Intravenous Injection of Recombinant Coagulation Factor VIII Fc-Von Willebrand Factor-XTEN Fusion Protein (rFVIIIFc-VWF-XTEN) (BIVV001) in Previously Treated Adults with Severe Hemophilia A (Exten-A)", Study Results, ClinicalTrials.gov Identifier: NCT03205163, https://clinicaltrials.gov/archive/NCT03205163.
Clinicaltrials.gov, (Apr. 7, 2023) "A Safety, Tolerability, and Pharmacokinetics Study of a Single Intravenous Injection of Recombinant Coagulation Factor VIII Fc-Von Willebrand Factor-XTEN Fusion Protein (rFVIIIFc-VWF-XTEN) (BIVV001) in Previously Treated Adults with Severe Hemophilia A (Exten-A)", Tabular View, ClinicalTrials.gov Identifier: NCT03205163, https://clinicaltrials.gov/archive/NCT03205163.
Clinicaltrials.gov, (Feb. 23, 2023) "A Phase 3, Open-label Interventional Study of an Intravenous Recombinant Coagulation Factor VIII Fc-von Willebrand Factor-XTEN Fusion Protein, Efanesoctocog Alfa (BIVV001), in Patients with Severe Hemophilia (XTEND-1)", History of Changes, ClinicalTrials.gov Identifier: NCT04161495, https://clinicaltrials.gov/archive/NCT04161495.
Clinicaltrials.gov, (Jan. 4, 2018) Bioverativ Therapeutics, Inc., NCT03205163, Protocol Title: A Phase 1/2a, Open-Label, Dose-Escalation Study to Determine the Safety, Tolerability, and Pharmacokinetics of a Single Intravenous Injection of rFVIIIFc-VWF-XTEN (BIVV001) in Previously Treated Adults With Severe Hemophilia A, Protocol No. 242HA 101, Phase of Development: 1/2a, Eudra CT No. 2017- 001140-34, Version 6.0.
Clinicaltrials.gov, (Jan. 23, 2023) "Safety, Efficacy and PK of BIVV 001 in Pediatric Patients with Hemophilia A (XTEND-Kids)", Study Details, ClinicalTrials.gov Identifier: NCT04759131, https://clinicaltrials.gov/archive/NCT04759131.
Clinicaltrials.gov, (Jan. 23, 2023) "Safety, Efficacy and PK of BIVV 001 in Pediatric Patients with Hemophilia A (XTEND-Kids)", Tabular View, ClinicalTrials.gov Identifier: NCT04759131, https://clinicaltrials.gov/archive/NCT04759131.
Clinicaltrials.gov, (Jul. 19, 2022) "A Phase 3, Open-label Interventional Study of an Intravenous Recombinant Coagulation Factor VIII Fc-von Willebrand Factor-XTEN Fusion Protein, Efanesoctocog Alfa (BIVV001), in Patients with Severe Hemophilia (XTEND-1)", Tabular View, ClinicalTrials.gov Identifier: NCT04161495, https://clinicaltrials.gov/archive/NCT04161495.
Clinicaltrials.gov, (Jul. 19, 2022) "A Phase 3, Open-label Interventional Study of an Intravenous Recombinant Coagulation Factor VIII Fc-von Willebrand Factor-XTEN Fusion Protein, Efanesoctocog Alfa (BIVV001), in Patients with Severe Hemophilia (XTEND-1)", Study Details, ClinicalTrials.gov Identifier: NCT04161495, https://clinicaltrials.gov/archive/NCT04161495.
Coia, et al. (1997) "Use of Mutator Cells as a Means for increasing Production Levels of a Recombinant Antibody Directed Against Hepatitis B", Gene, vol. 201, No. 1-2, pp. 203-209.
Collen, et al. (Oct. 10, 2000) "Polyethylene Glycol-Derivatized Cysteine-Substitution Variants of Recombinant Staphylokinase for Single-Bolus Treatment of Acute Myocardial Infarction", Circulation, vol. 102, Issue 15, pp. 1766-1772.
Collins et al., Break-through bleeding in relation to predicted factor VIII levels in patients receiving prophylactic treatment for severe hemophilia A, J Thromb Haemost, 2009, Mar,7(3): 413-420.
Collins et al., Recombinant long-acting glycoPEGylated factor IX in hemophilia B: a multinational randomized phase 3 trial, Blood, 2014, 124(26): 3880-3886.
Conticello, et al. (Feb. 2001) "Mechanisms for Evolving Hypervariability: The Case of Conopeptides", Molecular Biology and Evolution, Oxford University Press, United States, vol. 18, Issue 2, pp. 120-131.
Corisdeo, et al. (Apr. 2004) "Functional Expression and Display of An Antibody Fab Fragment in *Escherichia coli*: Study of Vector Designs and Culture Conditions", Protein Expression and Purification, vol. 34, Issue 2, pp. 270-279.
Corsaro, et al. (1981) "Enhancing the Efficiency of DNA-Mediated Gene Transfer in Mammalian Cells", Somatic Cell Genetics, vol. 7, No. 5, pp. 603-616.
Craik, et al. (Dec. 17, 1999) "Plant cyclotides: A Unique Family of Cyclic and Knotted Proteins that Defines the Cyclic Cystine Knot Structural Motif", Journal of Molecular Biology, vol. 294, Issue 5, Dec. 17, 1999, pp. 1327-1336.
Crameri, et al. (Apr. 1996) "Improved Green Fluorescent Protein by Molecular Evolution Using DNA Shuffling", Nature Biotechnology, vol. 14, No. 3, pp. 315-319.
Cull, et al. (Mar. 1, 1992) "Screening for Receptor Ligands Using Large Libraries of Peptides Linked to the C Terminus of the Lac Repressor", Proceedings of the National Academy of Sciences, vol. 89, No. 5, pp. 1865-1869.
Daley, et al. (Apr. 30, 2002) "Structure and Dynamics of a Beta-Helical Antifreeze Protein", Biochemistry, vol. 41, No. 17, pp. 5515-5525.
Daniel, et al. (May 1991) "Screening for Potassium Channel Modulators by a High Through-Put 86-Rubidium Efflux Assay in a 96-Well Microtiter Plate", Journal of Pharmacological Methods, vol. 25, Issue 3, pp. 185-193.
Danner, et al. (Nov. 6, 2001) "T7 Phage Display: A Novel Genetic Selection System for Cloning RNA-Binding Proteins From cDNA Libraries", Proceedings of the National Academy of Sciences of the United States of America, vol. 98, No. 23, pp. 12954-12959.
D'Aquino, et al. (Jun. 1996) "the Magnitude of the Backbone Conformational Entropy Change in Protein Folding", Proteins, vol. 25, Issue 2, pp. 143-156.
Database Geneseq [Online] (Sept. 8, 2020) "dTDP-4-dehydrorhamnose reductase [*Entomomonas moraniae*]", GenBank Accession No. AZS50750.1.
Dattani, et al. (1996) "An Investigation into the Lability of the Bioactivity of Human Growth Hormone Using the ESTA Bioassay", Hormone Research, vol. 46, No. 2, pp. 64-73.
Dauplais, et al. (Feb. 14, 1997) "on the Convergent Evolution of Animal Toxins", the Journal of Biological Chemistry, vol. 272, No. 7, pp. 4302-4309.
Davidson, M. W. (2009) "Engineered Fluorescent Proteins: Innovations and Applications", Nature Methods, vol. 6, No. 10, pp. 713-717.
De Boer, et al. (1983) "the Tac Promoter: A Functional Hybrid Derived from the Trp and Lac Promoters", Proceedings of the National Academy of Sciences, vol. 80, No. 1, pp. 21-25.
De Kruif, et al. (Apr. 21, 1995) "Selection and Application of Human Single Chain Fv Antibody Fragments from A Semi-Synthetic Phage Antibody Display Library with Designed CDR3 Regions", Journal of Molecular Biology, vol. 248, No. 1, pp. 97-105.

(56) References Cited

OTHER PUBLICATIONS

De, et al. (1994) "Crystal Structure of a Disulfide-Linked" Trefoil" Motif Found in a Large Family of Putative Growth Factors", Proceedings of the National Academy of Sciences, vol. 91, No. 3, pp. 1084-1088.
Deckert, et al. (2000) "Pharmacokinetics and Microdistribution of Polyethylene Glycol-Modified Humanized A33 Antibody Targeting Colon Cancer Xenografts", International Journal of Cancer, vol. 87, No. 3, pp. 382-390.
Delignat et al., "Immunoprotective effect of von Willebrand factor towards therapeutic factor VIII in experimental haemophilia A", Haemophilia, Mar. 2012, 18(2): 248-254.
Demers et al., "Efanesoctocog alfa elicits functional clot formation that is indistinguishable to that of recombinant factor VIII", Journal of Thrombosis and Haemostasis, Jul. 2022, 20(7): 1674-1583.
Den Uijl et al., Clinical severity of hemophilia A: does the classification of the 1950s still stand?, Hemophilia, 17: 849-853.
Denoto, et al. (1981) "Human Growth Hormone DNA Sequence and mRNA Structure: Possible Alternative Splicing", Nucleic Acids Research, vol. 9, No. 15, pp. 3719-3730.
Der Maur, et al. (2002) "Direct in Vivo Screening of intrabody Libraries Constructed on A Highly Stable Single-Chain Framework", The Journal of Biological Chemistry, vol. 277, No. 47, pp. 45075-45085.
Desplancq, et al. (1994) "Multimerization Behaviour of Single Chain Fv Variants for the Tumour-Binding Antibody B72.3,", Protein Engineering, vol. 7, No. 8, pp. 1027-1033.
Dhalluin, et al. (2005) "Structural and Biophysical Characterization of the 40 kDa Peg-Interferon-a2a and Its Individual Positional Isomers", Bioconjugate Chemistry, vol. 16, No. 3, pp. 504-517.
Di Lullo, et al. (2002) "Mapping the Ligand-Binding Sites and Disease-associated Mutations on the Most Abundant Protein in the Human, Type I Collagen", the Journal of Biological Chemistry, vol. 277, No. 6, pp. 4223-4231.
Di MICHELE et al., "Severe and moderate haemophilia A and B in US females". Haemophilia, Feb. 2014, 20: 136-143.
Diaz-Collier, et al. (1994) "Refold and Characterization of Recombinant Tissue Factor Pathway Inhibitor Expressed in *Escherichia coli*", Thrombosis and Haemostasis, vol. 71, No. 03, pp. 339-346.
Dietrich, et al. (2003) "ABC of Oral Bioavailability: Transporters as Gatekeepers in the Gut", Gut, vol. 52, No. 12, pp. 1788-1795.
Dolezal, et al. (2000) "ScFv Multimers of the Anti-Neuraminidase Antibody Nc10: Shortening of the Linker in Single-Chain Fv Fragment assembled in V(L) to V(H) orientation Drives the formation of Dimers, Trimers, Tetramers and Higher Molecular Mass Multimers", Protein Engineering, vol. 13, No. 8, pp. 565-574.
Donath et al., "Characterization of des-(741-1668)-factor VIII. A single-chain factor VIII variant with a fusion site susceptible to proteolysis by thrombin and factor Xa", Biochem J., 1995, vol. 312, pp. 49-55.
Dooley, et al. (1998) "Stabilization of Antibody Fragments in Adverse Environments", Biotechnology and Applied Biochemistry, vol. 28, Part 1, pp. 77-83.
Doyle, et al. (1996) "Crystal Structures of a Complexed and Peptide-Free Membrane Protein-Binding Domain: Molecular Basis of Peptide Recognition by PDZ", Cell, vol. 85, No. 7, pp. 1067-1076.
Duan et al., "Recombinant factor VIII Fc fusion protein engages monocytes via Fc and FVIII domains to reduce monocyte differentiation into osteoclasts", Frontier in Hematology, Nov. 3, 2022, 1-13.
Dufton, M. J. (1984) "Classification of Elapid Snake Neurotoxins and Cytotoxins According to Chain Length: Evolutionary Implications", Journal of Molecular Evolution, vol. 20, No. 2, pp. 128-134.
Dumoulin, et al. (Mar. 2002) "Single-Domain Antibody Fragments with High Conformational Stability", Protein Science, vol. 11, No. 3, pp. 500-515.
Dutton, et al. (2002) "A New Level of Conotoxin Diversity, A Non-Native Disulfide Bond Connectivity in Alpha-Conotoxin AulB Reduces Structural Definition But increases Biological Activity", The Journal of Biological Chemistry, vol. 277, No. 50, pp. 48849-48857.
Dyson, et al. (2004) "Production of Soluble Mammalian Proteins in *Escherichia coli*: Identification of Protein Features That Correlate with Successful Expression," BMC Biotechnology 4:32, American Society for Biochemistry and Molecular Biology, United States, BMC Biotechnology, vol. 4, No. 32.
Ellis, et al. (1994) "Valid and Invalid Implementations of GOR Secondary Structure Predictions", Computer Applications in Biosciences, vol. 10, No. 3, pp. 341-348.
European Search Report and opinion for European Application No. 08795371, mailed on Jan. 27, 2011.
Extended European Search report received for European Application No. 13735649.9, mailed on Nov. 3, 2015.
Extended European Search Report received for European Application No. 13816031.2, mailed on May 20, 2016, 7 Pages.
Extended European Search Report received for European Application No. 19210390.1, mailed on May 27, 2020, 11 Pages.
Extended European Search report received for European Application No. 22181403.1, mailed on Mar. 31, 2023.
Extended European Search Report received for European Patent Application No. 06804210, mailed on Feb. 4, 2010.
Extended European Search Report received for European Patent Application No. 07752549.1, dated Mar. 5, 2009.
Extended European Search Report received for European Patent Application No. 07752636.6, mailed on Mar. 26, 2009.
Extended European Search Report received for European Patent Application No. 12868427.1, mailed on Jan. 29, 2016.
Extended European Search Report received for European Patent Application No. 14817900.5, mailed on Feb. 21, 2017.
Extended European Search Report received for European Patent Application No. 15735473.9, mailed on Jun. 26, 2017.
Extended European Search Report received for European Patent Application No. 18211179.9, mailed on Mar. 22, 2019.
Extended European Search Report received for European Patent Application No. 19165518.2, mailed on Oct. 7, 2019.
Fair, et al. (1984) "Human Hepatoma Cells Secrete Single Chain Factor X, Prothrombin, and Antithrombin III", Blood, vol. 64, No. 1, pp. 194-204.
Fajloun, et al. (2000) "Maurotoxin Versus Pi1/Hstx1 Scorpion Toxins", the Journal of Biological Chemistry, vol. 275, No. 50, American Society for Biochemistry and Molecular Biology, pp. 39394-39402.
Fang, et al. (2007) "the Protein Structure and Effect of Factor VIII", Thrombosis Research, vol. 119, No. 1, pp. 1-13.
Fares, F. A. (1992) "Design of a Long-Acting Follitropin Agonist by Fusing the C-Terminal Sequence of the Chorionic Gonadotropin Beta Subunit to the Follitropin Beta Subunit", Proceedings of the National Academy of Sciences, vol. 89, No. 10, pp. 4304-4308.
FDA, BLA Approval Letter ALTUVIIIO to Bioverativ Therapeutics, Inc., Feb. 22, 2023.
Felici, et al. (1991) "Selection of Antibody Ligands from a Large Library of Oligopeptides Expressed on a Multivalent Exposition Vector", Journal of Molecular Biology, vol. 222, No. 2, pp. 301-310.
Fisher, et al. (2006) "Genetic Selection for Protein Solubility Enabled by the Folding Quality Control Feature of the Twin-Arginine Translocation Pathway", Protein Science, vol. 15, No. 3, pp. 449-458.
Fitzgerald, et al. (1995) "Interchangeability of Caenorhabditis Elegans DSL Proteins and Intrinsic Signalling Activity of their Extracellular Domains In Vivo", Development, vol. 121, No. 12, pp. 4275-4282.
Fraczkiewicz, et al. (1998) "Exact and Efficient Analytical Calculation of the Accessible Surface Areas and their Gradients for Macromolecules", Journal of Computational Chemistry, vol. 19, pp. 319-333.
Frampton, Efmoroctocog alfa: A Review in Haemophilia A. Drugs, 2016, Abstract, 76: 1281-1291.
Franz, T. J. (1975) "Percutaneous Absorption on the Relevance of in Vitro Data", Journal of Investigative Dermatology, vol. 64, No. 3, pp. 190-195.

(56) References Cited

OTHER PUBLICATIONS

Frenal, et al. (2004) "Exploring Structural Features of the interaction Between the Scorpion toxincnerg1 and ERG K+ Channels", Proteins, vol. 56, No. 2, pp. 367-375.
Fulcher, et al. (1985) "Localization of Human Factor FVIII Inhibitor Epitopes to Two Polypeptide Fragments", Proceedings of the National Academy of Sciences, vol. 82, No. 22, pp. 7728-7732.
Gamez, et al. (2005) "Development of Pegylated forms of Recombinant Rhodosporidium Toruloides Phenylalanine Ammonia-Lyase for the Treatment of Classical Phenylketonuria", The Journal of the American Society of Gene, Therapy 11, No. 6, pp. 986-989.
Garnier, et al. (1996) "GOR Method for Predicting Protein Secondary Structure from Amino Acid Sequence", Methods in Enzymology. Volume 266, Academic Press, pp. 540-553.
Geething, et al. (2010) "Gcg-XTEN: An Improved Glucagon Capable of Preventing Hypoglycemia without Increasing Baseline Blood Glucose", PLoS ONE, vol. 5, No. 4, e10175 Page.
Genbank (Jun. 11, 2015) "Hypothetical Protein TRAVEDRAFT_138159", EIW63862.1, Trametes versicolor FP-10 1664 SS1. Available at URL: http://www.ncbi.nlm.nih.gov/protein/392570690?report=genbank&log$=protalign&blas t_rank=1&RID=3ERSOM7501R, 3 Pages.
Genbank Database (Jan. 14, 1995) "Transferrin Precursor [Homo sapiens]", Accession No. AAA61140.1, accessed at http://www.ncbi.nlm.nih.gov/protein/AAA61140.1, 1 Page.
Genebank (2008) "Homo Sapiens Coagulation Factor VIII, Procoagulant Component (F8), Transcript Variant 1, mRNA", Accession No. NM_000132.3, accessed at http://www.ncbi.nlm.nih.gov/nuccore/NM_000132.3, 12 Pages.
George, et al. (2003) "An Analysis of Protein Domain Linkers: their Classification and Role in Protein Folding", Protein Engineering Design, vol. 15, No. 11, pp. 871-879.
Giangrande et al., Clinical evaluation of glycoPEGylated recombinant FVIII: Efficacy and safety in severe haemophilia A., Thromb Haemost., Jan. 26, 2017,117(2): 252-261.
Gilkes, et al. (1991) "Domains in Microbial Beta-1, 4-Glycanases: Sequence Conservation, Function, and Enzyme Families", Microbiological Reviews, vol. 55, No. 2, pp. 303-315.
Gilles, et al. (1993) "Anti-Factor VIII Antibodies of Hemophiliac Patients Are Frequently Directed Towards Nonfunctional Determinants and Do Not Exhibit Isotypic Restriction", Blood, vol. 82, No. 8, pp. 2452-2461.
Gleeson, et al. (1986) "Transformation of the Methylotrophic Yeast Hansenula Polymorpha", Microbiology. vol. 132, No. 12, pp. 3459-3465.
Goeddel, et al. (1980) "Synthesis of Human Fibroblast Interferon by E. Coli", Nucleic Acids Research, vol. 8, No. 18, pp. 4057-4074.
Goeddel, et al. (Oct. 18, 1979) "Direct Expression in *Escherichia Coli* of a DNA Sequence Coding for Human Growth Hormone", Nature, vol. 281, No. 5732, pp. 544-548.
Gomez-Duarte, et al. (1995) "Expression of Fragment C of Tetanus Toxin Fused to A Carboxyl-Terminal Fragment of Diphtheria toxin in Salmonella Typhi CVD 908 Vaccine Strain", Vaccine, vol. 13, No. 16, pp. 1596-1602.
Gouw, et al. (Nov. 2009) "the Multifactorial Etiology of Inhibitor Development in Hemophilia: Genetics and Environment", Seminars in Thrombosis and Hemostasis, vol. 35, No. 8, pp. 723-734.
Graff, et al. (2003) "theoretical Analysis of Antibody Targeting of Tumor Spheroids: Importance of Dosage for Penetration, and Affinity for Retention", Cancer Research, vol. 63, No. 6, pp. 1288-1296.
Graham, et al. (Apr. 1, 1973) "a New Technique for the Assay of Infectivity of Human Adenovirus 5 DNA", Virology, vol. 52, No. 2, pp. 456-467.
Graham, et al. (Jul. 1, 1977) "Characteristics of a Human Cell Line Transformed by DNA From Human Adenovirus Type 5", Journal of General Virology, vol. 36, No. 1, pp. 59-72.
Gray, et al. (1988) "Peptide Toxins from Venomous Conus Snails", Annual Review of Biochemistry, vol. 57, pp. 665-700.
Greenwald, et al. (2003) "Effective Drug Delivery by PEGylated Drug Conjugates", Advanced Drug Delivery Reviews, vol. 55, No. 2, pp. 217-250.
Gringeri et al., A randomized clinical trial of prophylaxis in children with hemophilia A (the ESPRIT Study), J Thromb Haemost., 2011, 9(4): 700-710.
Gruppo, et al. (May 2003) "Comparative Effectiveness of Full-Length and B-Domain Deleted Factor VIII for Prophylaxis-a Meta-Analysis", Haemophilia, vol. 9, No. 3, pp. 251-260.
Guncar, et al. (1999) "Crystal Structure of MHC Class li-associated P41 li Fragment Bound to Cathepsin L Reveals the Structural Basis for Differentiation Between Cathepsins L and S", The EMBO Journal, vol. 18, No. 4, pp. 793-803.
Guo, et al. (2005) "Crystal Structure of the Cysteine-Rich Secretory Protein Stecrisp Reveals That the Cysteine-Rich Domain Has A K + Channel inhibitor-Like Fold", he Journal of Biological Chemistry, vol. 280, No. 13, p. 12405-12412.
Gupta et al., Regulation of immune responses to protein therapeutics by transplacental induction of T cell tolerance, Sci Transl Med., 2015, 7(275): 275ra21.
Gustafsson, et al. (2004) "Codon Bias and Heterologous Protein Expression", Trends in Biotechnology, vol. 22, No. 7, pp. 346-353.
Haberichter et al., "Regulated Release of VWF and FVIII and the Biologic Implications", Pediatric Blood Cancer, May 2006, 46(5): 547-553.
Hamers-Casterman, et al. (Jun. 3, 1993) "Naturally Occurring Antibodies Devoid of Light Chains", Nature, vol. 363, No. 6428, pp. 446-448.
Hammer, J. (1995) "New Methods to Predict MHC-Binding Sequences within Protein Antigens", Current Opinion in Immunology, vol. 7, No. 2, pp. 263-269.
Harlow, et al. (1988) "Cell Staining", Cold Spring Harbor Laboratory, pp. 359-420.
Harris, et al. (2000) "Rapid and General Profiling of Protease Specificity by Using Combinatorial Fluorogenic Substrate Libraries", Proceedings of the National Academy of Sciences, vol. 97, No. 14, pp. 7754-7759.
Harris, et al. (2003) "Effect of Pegylation on Pharmaceuticals", Nature Reviews Drug Discovery, vol. 2, No. 3, pp. 214-221.
Hedner, et al. (1983) "Use of Human Factor Vlla in The Treatment of Two Hemophilia a Patients with High-Titer inhibitors", The Journal of Clinical Investigation vol. 71, No. 6, pp. 1836-1841.
Hedner, U. (2000) "NovoSeven® as a Universal Haemostatic Agent", Blood Coagulation & Fibrinolysis II, Supplement 1, pp. S107-S111.
Heinz et al. (Nov. 2009) "Factor VIII-eGFP Fusion Proteins with Preserved Functional Activity for the Analysis of the Early Secretory Pathway of Factor VIII", Thrombosis and Haemostasis, vol. 102, No. 5, pp. 925-935.
Hennighausen et al., "Mouse Whey Acidic Protein is A Novel Member of the Family of Four-Disulfide Core' Proteins", Nucleic Acids Research, Apr. 1982, vol. 10, No. 8, pp. 2677-2684.
Hermeling, et al. (2004) "Structure-Immunogenicity Relationships of therapeutic Proteins", Pharmaceutical Research, vol. 21, No. 6, pp. 897-903.
Higgins, et al. (1995) "Characterization of Mutant forms of Recombinant Human Properdin Lacking NPL177 Single Thrombospondin Type I Repeats", Journal of Immunology, vol. 155, No. 12, pp. 5777-5785.
Higgins, et al. (1995) "Polyclonal and Clonal Analysis of Human Cd4+ T-Lymphocyte Responses to Nut Extracts", Immunology, vol. 84, No. 1, pp. 91-97.
Hill, et al. (2000) "Conotoxin TVIIA, A Novel Peptide from the Venom of Conus Tulipa 1", European NPL178 Journal of Biochemistry/FEBS, vol. 267, No. 15, pp. 4642-4648.
Hinds, et al. (2005) "PEGylated insulin in PLGA Microparticles. in Vivo and in Vitro Analysis", Journal of Controlled Release, vol. 104, No. 3, pp. 447-460.
Hirel, et al. (1989) "Extent of N-Terminal Methionine Excision from *Escherichia Coli* Proteins is Governed by the Side-Chain Length of the Penultimate Amino Acid", Proceedings of the National Academy of Sciences of the United States of America, vol. 86, No. 21, pp. 8247-8251.

(56) References Cited

OTHER PUBLICATIONS

Hogg, P. J. (2003) "Disulfide Bonds as Switches for Protein Function", Trends in Biochemical Sciences, vol. 28, No. 4, pp. 210-214.
Holevinsky, et al. (1994) "ATP-Sensitive K+ Channel Opener Acts as A Potent CI-Channel inhibitor in Vascular Smooth Muscle Cells", The Journal of Membrane Biology 137, No. 1, pp. 59-70.
Hopp, et al. (1981) "Prediction of Protein Antigenic Determinants from Amino Acid Sequences", Proceedings of the National Academy of Sciences, vol. 78, No. 6, pp. 3824-3828.
Horvais et al., "rFVIII-Fc in severe haemophilia A: The incentive switch in case of high risk of joint bleedings", Eur J Clin Invest., Oct. 2022, 52(10): e13824, 11 pages.
Hsu, et al. (2000) "Vaccination Against Gonadotropin-Releasing Hormone (GnRH) Using toxin Receptor-Binding Domain-Conjugated GnRH Repeats", Cancer Research, vol. 60, No. 14, pp. 3701-3705.
Hudson, et al. (1999) "High Avidity ScFv Multimers; Diabodies and Triabodies", Journal of Immunological Methods, vol. 231, No. 1-2, pp. 177-189.
Hugli, T. E. (1990) "Structure and Function of C3A Anaphylatoxin", Current topics in Microbiology and Immunology, vol. 153, pp. 181-208. Hugli, T. E. (1990) "Structure and Function of C3A Anaphylatoxin", Current topics in Microbiology and Immunology, vol. 153, pp. 181-208.
Huston, et al. (Aug. 1988) "Protein Engineering of Antibody Binding Sites: Recovery of Specific Activity in an Anti-Digoxin Single-Chain Fv Analogue Produced in *Escherichia coli*", Proceedings of the National Academy of Sciences of the United States of America, vol. 85, No. 16, pp. 5879-5883.
International Preliminary Report on Patentability for PCT International Patent Application No. PCT/US2015/010738, International Bureau of WIPO, Geneva, Switzerland, mailed on Jul. 12, 2016.
International Search Report and Written Opinion received for PCT Patent Application No. PCT/US2006/037713, mailed on Jan. 17, 2008.
International Search Report and Written Opinion received for PCT Patent Application No. PCT/US2007/005857, mailed on Sep. 26, 2007.
International Search Report and Written Opinion received for PCT Patent Application No. PCT/US2007/005952, mailed on Dec. 26, 2007.
International Search Report and Written Opinion received for PCT Patent Application No. PCT/US2008/009787, mailed on Mar. 16, 2009.
International Search Report and Written Opinion received for PCT Patent Application No. PCT/US2010/002147, mailed on Dec. 20, 2010.
International Search Report and Written Opinion received for PCT Patent Application No. PCT/US2010/002148, mailed on Dec. 1, 2010.
International Search Report and Written Opinion received for PCT Patent Application No. PCT/US2010/023106, mailed on Apr. 20, 2010.
International Search Report and Written Opinion received for PCT Patent Application No. PCT/US2010/037855, mailed on Oct. 29, 2010.
International Search Report and Written Opinion received for PCT Patent Application No. PCT/US2010/061590, mailed on Jul. 12, 2011.
International Search Report and Written Opinion received for PCT Patent Application No. PCT/US2011/043568, mailed on Nov. 25, 2011.
International Search Report and Written Opinion received for PCT Patent Application No. PCT/US2011/048517, mailed on Mar. 14, 2012.
International Search Report and Written Opinion received for PCT Patent Application No. PCT/US2012/046326, mailed on Jan. 25, 2013.
International Search Report and Written Opinion received for PCT Patent Application No. PCT/US2013/026521, mailed on Apr. 24, 2013.
International Search Report and Written Opinion received for PCT Patent Application No. PCT/US2014/040370, mailed on Jan. 9, 2015.
International Search Report and Written Opinion received for PCT Patent Application No. PCT/US2014/051144, mailed on Feb. 10, 2015.
International Search Report and Written Opinion received for PCT Patent Application No. PCT/US2021/037926, mailed on Nov. 9, 2021.
Iwasaki, et al. (1997) "Solution Structure of Midkine, a New Heparin-Binding Growth Factor", the EMBO Journal, vol. 16, No. 23, pp. 6936-6946.
Jackson, et al. (2007) "The Characterization of Paclitaxel-Loaded Micro Spheres Manufactured from Blends of Poly (Lactic-Co-Glycolic Acid) (PLGA) and Low Molecular Weight Diblock Copolymers", International Journal of Pharmaceutics, vol. 342, No. 1-2, pp. 6-17.
Jacquemin, et al. (2000) "A Human Antibody Directed to The Factor VIII C1 Domain inhibits Factor VIII Cofactor Activity and Binding to Von Willebrand Factor", Blood, vol. 95, No. 1, pp. 156-163.
Jenkins et al., Elevated factor VIII levels and risk of venous thrombosis, Brit J Haematology. 2012, 157: 653-663.
JIVI [package insert], Whippany, NJ: Bayer HealthCare LLC, 2018.
Johansson, et al. (2007) "Modifications Increasing the Efficacy of Recombinant Vaccines; Marked Increase in Antibody Titers with Moderately Repetitive Variants of a Therapeutic Allergy Vaccine", Vaccine, vol. 25, No. 9, pp. 1676-1682.
Jonassen, et al. (1995) "Finding Flexible Patterns in Unaligned Protein Sequences", Protein Science, vol. 4, No. 8, pp. 1587-1595.
Jones, et al. (1997) "Determination of Tumor Necrosis Factor Binding Protein Disulfide Structure: Deviation of the Fourth Domain Structure from the TNFR/NGFR Family Cysteine-Rich Region Signature", Biochemistry, vol. 36, No. 48, pp. 14914-14923.
Jones, et al. (May 29, 1986) "Replacing the Complementarity-Determining Regions in a Human Antibody with Those from a Mouse", Nature, vol. 321, No. 6069, pp. 522-525.
Jonsson, et al. (1993) "Quantitative Sequence-Activity Models (QSAM) —Tools for Sequence Design", Nucleic Acids Research, vol. 21, No. 3, pp. 733-739.
Joosten, et al. (2011) "A Series of PDB Related Databases for Everyday Needs", Nucleic Acids D Research, vol. 39, pp. D411-D419.
Jung, et al. (1997) "Improving In Vivo Folding and Stability of a Single-Chain Fv Antibody Fragment by Loop Grafting", Protein Engineering, vol. 10, No. 8, pp. 959-966.
Kabsch, et al. (1983) "Dictionary of Protein Secondary Structure: Pattern Recognition of Hydrogen-Bonded and Geometrical Features", Biopolymers, vol. 22, No. 12, pp. 2577-2637.
Kamikubo, et al. (2004) "Disulfide Bonding Arrangements in Active forms of the Somatomedin B Domain of Human Vitronectin", Biochemistry, vol. 43, No. 21, pp. 6519-6534.
Kasper, CK, et al. (Nov. 15, 1975) "Proceedings: A More Uniform Measurement of Factor VIII Inhibitors", Thrombosis et diathesis haemorrhagica, vol. 34, No. 2, 612 Page.
Kasuda, et al. (Aug. 2008) "Establishment of Embryonic Stem Cells Secreting Human Factor VIII for Cell-Based Treatment of Hemophilia A", Journal of Thrombosis and Haemostasis, vol. 6, No. 8, pp. 1352-1359.
Katragadda et al., "Population pharmacokinetic (PK) analysis of bivv001 (rFVIIIFc-VWF-xten), a new class of factor VIII (FVIII) replacement", Research and Practice in Thrombosis and Haemostasis, Jul. 2020, 4(Suppl 1): 474.
Kaufman, et al. (1982) "Amplification and Expression of Sequences Cotransfected with a Modular Dihydrofolate Reductase Complementary DNA Gene", Journal of Molecular Biology, vol. 159, No. 4, pp. 601-621.
Kaufman, et al. (1982) "Construction of a Modular Dihydrofolate Reductase cDNA Gene: Analysis of Signals Utilized for Efficient Expression", Molecular and Cellular Biology, vol. 2, No. 11, pp. 1304-1319.

(56) References Cited

OTHER PUBLICATIONS

Kavakli et al., Prophylaxis vs. on-demand treatment with BAY 81-8973, a full-length plasma protein-free recombinant factor VIII product: results from a randomized trial (Leopold II), J Thromb Haemost., Mar. 13, 2015, 13(3): 360-369.

Kay, et al. (1993) "An M13 Phage Library Displaying Random 38-Amino-Acid Peptides as a Source of Novel Sequences with Affinity to Selected Targets", Gene, vol. 128, No. 1, pp. 59-65.

Kazatchkine, et al. (1980) "Circulating Immune Complexes Containing Anti-VIII Antibodies in Multi-Transfused Patients with Haemophilia A", American Journal of Clinical and Experimental Immunology, vol. 39, No. 2, pp. 315-320.

Kelly, et al. (2003) "Isolation of a Colon Tumor Specific Binding Peptide Using Phage Display Selection", Neoplasia, vol. 5, No. 5, pp. 437-444.

Kemball-Cook, et al. (1998) "the factor VIII Structure and Mutation Resource Site: HAMSTERS Version 4", Nucleic Acids Research, vol. 26, No. 1, pp. 216-219.

Khan, et al. (1998) "Solubilization of Recombinant Ovine Growth Hormone with Retention of Native-Like Secondary Structure and Its Refolding from the Inclusion Bodies of *Escherichia Coli*", Biotechnology Progress, vol. 14, No. 5, pp. 722-728.

Kim, et al. (1995) "Three-Dimensional Solution Structure of the Calcium Channel Antagonist Omega-Agatoxin Iva: Consensus Molecular Folding of Calcium Channel Blockers", Journal of Molecular Biology, vol. 250, No. 5, pp. 659-671.

Kimble, et al. (1997) "the Lin-12/Notch Signaling Pathway and Its Regulation", Annual Review of Cell and Developmental Biology, pp. 333-361.

Kingdon et al., An adventure in biotechnology: the development of haemophilia A therapeutics from whole blood transfusion to recombinant DNA to gene therapy, Biotechnol Appl Biochem., 2002, 35(Pt 2): 141-148.

Kisiel, et al. (1983) "Enzymological Aspects of Blood Coagulation", Behring Institute Mitteilungen, vol. 73, pp. 29-42.

Kissel, et al. (2002) "Aba-Triblock Copolymers from Biodegradable Polyester A-Blocks and Hydrophilic Poly (Ethylene Oxide) B-Blocks as a Candidate for In Situ forming Hydrogel Delivery Systems for Proteins", Advanced Drug Delivery Reviews, vol. 54, No. 1, pp. 99-134.

Klamroth al., Results from a phase 3, randomize, multicenter study of rurioctocog alfa pegol PK-guided prophylaxis targeting 2 FVIII trough levels in patients with severe hemophilia A (propel study), Poster P255 presented at: European Association for Haemophilia and Allied Disorders (EAHAD), 2019, Feb 6-9, Prague, Czech Republic.

Klamroth et al., "Perioperative Management with Efanesoctocog Alfa in Patients with Hemophilia A in the Phase 3 XTEND-1 Study", Abstract, Haemophilia, 87-88.

Klamroth et al., "Perioperative Management with Efanesoctocog Alfa in Patients with Hemophilia A in the Phase 3 XTEND-1 Study", Poster, 16th Annual Congress of the European Association for Haemophilia and Allied Disorders, Feb. 7-10, 2023.

Klitgaard, et al. (2008) "Overview of the Human Pharmacokinetics of Recombinant Activated Factor VII", British Journal of Clinical Pharmacology, vol. 65, No. 1, pp. 3-11.

Kochendoerfer, G. "Chemical and Biological Properties of Polymer-Modified Proteins", Expert Opinion on Biological therapy, vol. 3, No. 8, pp. 1253-1261.

Kogenate [package insert], Whippany, NJ: Bayer HealthCare LLC, 2016.

Kohn, et al. (2004) "Random-Coil Behavior and the Dimensions of Chemically Unfolded Proteins", Proceedings of the National Academy of Sciences, vol. 101, No. 34, p. 12491-14296.

Koide, et al. (1998) "the Fibronectin Type III Domain as a Scaffold for Novel Binding Proteins", Journal of Molecular Biology, vol. 284, No. 4, pp. 1141-1151.

Konigs et al., "First study of extended half-life rFVIIIFc in previously untreated patients with hemophilia A: PUPs A-LONG final results", Blood, Jun. 30, 2022, 139(26): 3699-3707.

Konkle et al., "BIVV001: The First Investigational Factor VIII Therapy to Break Through the VWF Ceiling in Hemophilia A, with Potential for Extended Protection for One Week or Longer", Blood, Amer Soc of Hematology US, Nov. 29, 2018, 132: 636.

Kornblatt, et al. (1980) "Cross-Linking of Cytochrome Oxidase Subunits with Difluorodinitrobenzene", Canadian Journal of Biochemistry, vol. 58, No. 3, pp. 219-224.

Kortt, et al. (1997) "Single-Chain Fv Fragments of Anti-Neuraminidase Antibody Nc10 Containing Five-and Ten-Residue Linkers Form Dimers and with Zero-Residue Linker a Trimer", Protein Engineering, vol. 10, No. 4, pp. 423-433.

Kou, et al. (2007) "Preparation and Characterization of Recombinant Protein ScFv(Cd11C)-Trp2 for Tumor therapy from inclusion Bodies in *Escherichia Coli*", Protein Expression and Purification, vol. 52, No. 1, pp. 131-138.

Kratzner, et al. (2005) "Structure of Ecballium Elaterium Trypsin inhibitor Ii (EETI Ii): A Rigid Molecular Scaffold", Acta Crystallographica, vol. 61, Part 9, pp. 1255-1262.

Krishnan et al., "Thrombin cleavage analysis of a novel antihaemophilic factor variant, factor VIII ΔII", Eur. J. Biochem. vol. 195, 1991, pp. 637-644.

Kristensen, et al. (1998) "Proteolytic Selection for Protein Folding Using Filamentous Bacteriophages", Folding & Design, vol. 3, No. 5, pp. 321-328.

Kubetzko, et al. (Nov. 1, 2005) "Protein PEGylation Decreases Observed Target Association Rates Via A Dual Blocking Mechanism", Molecular Pharmacology vol. 68, No. 5, The American Society for Pharmacology and Experimental Therapeutics, United States, pp. 1439-1454.

Kulkarni et al., "Clinical Development of Efanesoctocog Alfa (BIV001), A New Class of Factor VIII (FVIII) Replacement Therapy Designed to Provide High Sustained Factor Activity", Abstract, THSNA 2022 Summit Abstract Proceedings, American Journal of Hematology, E601-E61.

Kulkarni et al., "Clinical Development of Efanesoctocog Alfa (BIV001), A New Class of Factor VIII (FVIII) Replacement Therapy Designed to Provide High Sustained Factor Activity", Poster, THSNA 2022 Summit of North America, Aug. 16-18, 2022.

Kulman, et al. (2007) "A Versatile System for Site-Specific Enzymatic Biotinylation and Regulated Expression of Proteins in Cultured Mammalian Cells", Protein Expression and Purification, vol. 52, No. 2, pp. 320-328.

Kurachi, et al. (1982) "Isolation and Characterization of A cDNA Coding for Human Factor IX", Proceedings of the National Academy of Sciences, pp. 6461-6464.

Kwon, et al. (Feb. 2004) "Biodegradable Triblock Copolymer Microspheres Based on thermosensitive Sol-Gel Transition", Pharmaceutical Research, vol. 21, Issue 2, pp. 339-343.

Lane, et al. (Jan. 3, 2006) "Influence of Post-Emulsification Drying Processes on the Microencapsulation of Human Serum Albumin", International Journal of Pharmaceutics, vol. 307, No. 1, pp. 16-22.

Lapatto, et al. "X-ray Structure of Antistasin at 1.9 Å Resolution and Its Modelled Complex with Blood Coagulation Factor Xa", the EMBO Journal, Sep. 1997, vol. 16, No. 17, Wiley Blackwell, England, pp. 5151-5161.

Lauber, et al. (Apr. 18, 2003) "Homologous Proteins with Different Folds: The Three-Dimensional Structures of Domains 1 and 6 of the Multiple Kazal-Type inhibitor LEKTI", Journal of Molecular Biology, vol. 328, No. 1, pp. 205-219.

Lavigne-Lissalde, et al. (Oct. 2009) "Characteristics, mechanisms of action, and epitope mapping of anti-factor VIII antibodies", Clinical Reviews in Allergy & Immunology, vol. 37, No. 2, pp. 67-79.

Le Gall, et al. (Jun. 1999) "Di-, Tri-and Tetrameric Single Chain Fv Antibody Fragments Against Human Cd19: Effect of Valency on Cell Binding", FEBS letters, vol. 453, No. 1-2, pp. 164-168.

Lee, et al. (Dec. 1999) "Pharmacokinetics of Recombinant Factor VIII (Recombinate) Using One-Stage Clotting and Chromogenic Factor VIII Assay", Journal of Thrombosis and Haemostasis, vol. 82, No. 6, pp. 1644-1647.

(56) References Cited

OTHER PUBLICATIONS

Lee, et al. "A recombinant human G-CSF/GM-CSF fusion protein from E. coli showing colony stimulating activity on human bone marrow cells", Biotechnology Letters, Feb. 2003, vol. 25, No. 3, pp. 205-211.

Lee, Vincent H. (2001) "Mucosal Drug Delivery", Journal of the National Cancer Institute Monographs, vol. 29, pp. 41-44.

Lehtinen et al., "Surgical outcomes in patients with haemophilia A or B receiving extended half-life recombinant factor VIII and IX Fc fusion proteins: Real-world eperience in the Nordic countries", Haemophilia, Sep. 2022, 28(5): 713-719.

Lenting, et al. (Aug. 20, 1999) "the light chain of factor VIII comprises a binding site for low density lipoprotein receptor-related protein", the Journal of Biological Chemistry, vol. 274, No. 34, pp. 23734-23739.

Lentz et al., Results from a large multinational clinical trial (guardian 1) using prophylactic treatment with turocotocog alfa in adolescent and adult patients with severe haemophilia A: safety and efficacy., Haeomophilia. 2013, 691-697.

Leong, et al. (Feb. 4, 2003) "Optimized Expression and Specific Activity of 11-12 by Directed Molecular Evolution", Proceedings of the National Academy of Sciences of the United States of America, vol. 100, No. 3, pp. 1163-1168.

Leong, et al. (Nov. 2001) "Adapting Pharmacokinetic Properties of a Humanized Anti-Interleukin-8 Antibody for therapeutic Applications Using Site-Specific Pegylation", Cytokine, vol. 16, Issue 3, pp. 106-119.

Lethagen, et al. (Nov. 1986) "Clinical Application of the Chromogenic Assay of Factor VIII in Haemophilia A, and Different Variants of von Willebrand's Disease", Scandinavian Journal of Haematology, vol. 37, No. 5, pp. 448-453.

Leung, et al. (1989) "A Method for Random Mutagenesis of a Defined DNA Segment Using a modified Polymerase Chain Reaction", Technique, vol. 1, pp. 11-15.

Leung-Hagesteijn, et al. (1992) "Unc-5, A Transmembrane Protein with Immunoglobulin and Thrombospondin Type 1 Domains, Guides Cell and Pioneer Axon Migrations in C", Cell, vol. 71, No. 2, pp. 289-299.

Levitt, et al. (1976) "A Simplified Representation of Protein Conformations for Rapid Simulation of Protein Folding", Journal of Molecular Biology, vol. 104, No. 1, pp. 59-107.

Levy, et al. (2007) "Isolation of Trans-Acting Genes That Enhance Soluble Expression of ScFv Antibodies in the E", Journal of Immunological Methods, vol. 321, No. 1-2, pp. 164-173.

Leyte, et al. (1989) "The Interaction Between Human Blood-Coagulation Factor VIII and Von Willebrand Factor: Characterization of a High-Affinity Binding Site on Factor VIII", Biochemical Journal 257, No. 3, pp. 679-683.

Li, et al. (1997) "The Physical Exchange of Factor VIII (FVIII) between von Willebrand Factor and Activated Platelets and the Effect of the FVIII B-Domain on Platelet Binding", Biochemistry, vol. 36, pp. 10760-10767.

Lin, et al. (2007) "Metal-Chelating Affinity Hydrogels for Sustained Protein Release", Journal of Biomedical Materials Research, Part A, vol. 83, No. 4, pp. 954-964.

Lippi, et al. (2007) "Diagnostic Approach to Inherited Bleeding Disorders", Clinical Chemistry and Laboratory Medicine, vol. 45, No. 1, pp. 2-12.

Lirazan, et al. (2000) "the Spasmodic Peptide Defines a New Conotoxin Superfamily", Biochemistry, vol. 39, No. 7, pp. 1583-1588.

Lissitchkov et al., "A Phase 1 Sequential Pharmacokinetic (PK) Evaluation of Octocog Alfa, Rurioctocog Alfa Pegol, ad Efanesoctocog Alfa in Severe Hemophilia A", Abstract, Haemophilia, 107-108, NHF 2022 Congress: Aug. 25-27, 2022.

Lissitchkov et al., "A Phase 1 Sequential Pharmacokinetic (PK) Evaluation of Octocog Alfa, Rurioctocog Alfa Pegol, ad Efanesoctocog Alfa in Severe Hemophilia A", Presentation slides, World Federation of Hemophilia, NHF 2022 Congress: Aug. 25-27, 2022.

Lissitchkov et al., "A Phase 1 Sequential Pharmacokinetic (PK) Evaluation of Octocog Alfa, Rurioctocog Alfa Pegol, and Efanesoctocog Alfa in Severe Hemophilia A", Efanesoctocog alfa Phase 1 PK Abstract-Encore, NHF 2022 Congress: Aug. 25-27, 2022.

Lissitchkov et al., "A Phase 1 Sequential Pharmacokinetic (PK) Evaluation of Octocog Alfa, Rurioctocog Alfa Pegol, and Efanesoctocog Alfa in Severe Hemophilia A", Poster, Blood 2022 Congress: Sep. 11-14, 2022, Sydney.

Lissitchkov et al., "A Phase 1 Sequential Pharmacokinetic (PK) Evaluation of Octocog Alfa, Rurioctocog Alfa Pegol, and Efanesoctocog Alfa in Severe Hemophilia A", Poster, NHF 74th Annual Bleeding Disorders Conference (BDC) 2022, Aug. 25- 27, 2022.

Lissitchkov et al., "Efanesoctocog alfa for hemophilia A: results from a phase 1 repeat-dose study", Blood Advances, Feb. 11, 2022, 6(4): 1089-1094.

Lissitchkov et al., "Efanesoctocog alfa Phase 1 PK" Abstract Encore, Blood 2022 Congress: Sep. 11-14, 2022, Sydney.

Lissitchkov et al., "Phase 1 Repeat Dosing with BIVV001: The First Investigational Factor VIII Product to Break through the Von Willebrand Factor-Imposed Half-Life Ceiling", Blood, Amer Soc of Hematology US, Nov. 13, 2019, 134: 625.

Liu, et al. (1997) "the Human Beta-Defensin-1 and Alpha-Defensins are Encoded by Adjacent Genes: Two Peptide Families with Differing Disulfide Topology Share a Common Ancestry", Genomics, vol. 43, No. 3, pp. 316-320.

Liu, et al. (2007) "Evaluation of PEG-FVIII Molecules with Prolonged Half-lives in a Murine FVIII Dependent Bleeding Model", Journal of Thrombosis and Haemostasis, vol. 9, Suppl. 2: P-M-035, ISTH Meeting, Abstract: Factor VIII, Factor V, Exhibition Area, International Society on Thrombosis and Haemostasis, United States, 1 page.

Lollar, et al. (Jun. 1994) "Inhibition of Human Factor Villa by Anti-A2 Subunit Antibodies", the Journal of Clinical Investigation, vol. 93, No. 6, pp. 2497-2504.

London, et al. (Jul. 20, 2000) "Zymogen Factor IX Potentiates Factor IXa-Catalyzed Factor X Activation", Biochemistry, vol. 39, No. 32, pp. 9850-9858.

Lowman, et al. (Nov. 12, 1991) "Selecting High-Affinity Binding Proteins by Monovalent Phage Display", Biochemistry, vol. 30, No. 45, pp. 10832-10838.

Loyter, et al. (Jan. 1982) "Mechanisms of DNA Uptake by Mammalian Cells: Fate of Exogenously Added DNA Monitored by the Use of Fluorescent Dyes", Proceedings of the National Academy of Sciences, vol. 79, No. 2, pp. 422-426.

Lusher, Hemophilia: From plasma to recombinant factors, 2008, In: 50 Years in Hematology Research That Revolutionized Patient Care. Washington, DC: American Society of Hematology, pp. 25-27. Available from: http://www.hematology.org/Publications/50 Years in Hematology/4323.aspx.

Maggio (2006) "A Renaissance in Peptide therapeutics is Underway", Drug Delivery Reports, pp. 23-26.

Maggio, Edward (Jul. 2006) "Intravail: Highly Effective Intranasal Delivery of Peptide and Protein Drugs", Expert Opinion on Drug Delivery, vol. 3, No. 4, pp. 529-539.

Mahlangu et al., Efficacy and safety of rVIII-SingleChain: results of a phase 1/3 multicenter clinical trial in severe hemophilia A, Blood, 2016, Aug, 128(5): 630-637.

Mahlangu et al., Emicizumab Prophylaxis in Patients Who Have Hemophilia A without Inhibitors, The New England Journal of Medicine, 2018, 811-822.

Maillere (Jun. 15, 1993) "Role of Thiols in the Presentation of a Snake Toxin to Murine T Cells", Journal of Immunology, vol. 150, No. 12, pp. 5270-5280.

Maillere, et al. (Apr. 1995) "Immunogenicity of a Disulphide-Containing Neurotoxin: Presentation to T-Cells Requires a Reduction Step", Toxicon, vol. 33, No. 4, pp. 475-482.

Mair et al., Thinking about the burden of treatment, BMJ, 2014, 349.

Malardier, et al. (May 15, 1989) "Cloning of the Nitrate Reductase Gene (niaD) of Aspergillus Nidulans and its Use for Transformation of Fusarium Oxysporum", Gene, vol. 78, No. 1, pp. 147-156.

(56) References Cited

OTHER PUBLICATIONS

Malec L, et al. LBA-5 Efficacy of rFVIIIFc for first-time immune tolerance induction (ITI) therapy: Final results from the Global, Prospective VerITI-8 Study. Presented at ASH 2021.
Manco-Johnson et al., Prophylaxis usage, bleeding rates, and joint outcomes of hemophilia, 1999 to 2010: a surveillance project, Blood, 2017, 2368-2374.
Manco-Johson et al., Randomized, controlled, parallel-group trial of routine prophylaxis vs. on-demand treatment with sucrose-formulated recombinant factor VIII in adults with severe hemophilia A (Spinart), J Thromb Haemost., 2013, Jun. 11(6): 1119-1127.
Marshall, et al. (Aug. 25, 2004) "Enhancing the Activity of a Beta-Helical Antifreeze Protein by the Engineered Addition of Coils", Biochemistry, vol. 43, No. 37, pp. 11637-11646.
Martin, et al. (Apr. 1999) "Evaluation of a Novel ELISA Screening Test for Detection of Factor VIII Inhibitory Antibodies in Haemophiliacs", Clinical & Laboratory Haematology, vol. 21, No. 2, pp. 125-128.
Martin, et al. (Jan. 2003) "Rational Design of a CD4 Mimic that Inhibits HIV-1 Entry and Exposes Cryptic Neutralization Epitopes", Nature Biotechnology, vol. 21, No. 1, pp. 71-76.
Martineau, et al. (Jul. 3, 1998) "Expression of an Antibody Fragment at High Levels in the Bacterial Cytoplasm", Journal of Molecular Biology, vol. 280, No. 1, pp. 117-127.
Matsumoto, et al. (2006) "the Measurement of Low Levels of Factor Viii or Factor IX in Hemophilia A and Hemophilia B Plasma by Clot Waveform Analysis and Thrombin Generation Assay", Journal of Thrombosis and Haemostasis, vol. 4, No. 2, pp. 377-384.
Matthews, et al. (May 21, 1993) "Substrate Phage: Selection of Protease Substrates by Monovalent Phage Display", Science, vol. 260, No. 5111, pp. 1113-1117.
Mazepa et al., Men with severe hemophilia in the United States: birth cohort analysis of a large national database, Blood, 2016, 127: 3073-3081.
McDonald, et al. (Sep. 15, 2002) "Significance of Blood Vessel Leakiness in Cancer", Cancer Research, vol. 62, No. 18, pp. 5381-5385.
McEneny-King et al., "Development and evaluation of a generic population pharmacokinetic model for standard half-life factor VIII for use in dose individualization", Journ Pharmacokinet Pharmacodyn., Oct. 2019, 46(5): 411-426.
McKnight, et al. (Aug. 1, 1985) "Identification and Molecular Analysis of a Third Aspergillus Nidulans Alcohol Dehydrogenase Gene", the EMBO Journal, vol. 4, No. 8, pp. 2093-2099.
McNulty, et al. (Nov. 29, 2001) "High-Resolution NMR Structure of the Chemically-Synthesized Melanocortin Receptor Binding Domain AGRP (87-132) of the Agouti-Related Protein", Biochemistry, vol. 40, No. 51, pp. 15520-15527.
Meeks et al. (Apr. 2009) "Non-Classical Anti-Factor VIII C2 Domain Antibodies are Pathogenic in a Murine In vivo Bleeding Model", Journal of Thrombosis and Haemostasis, vol. 7, No. 4, pp. 658-664.
Meeks, et al. (Dec. 15, 2007) "Antihuman Factor VIII C2 Domain Antibodies in Hemophilia a Mice Recognize a Functionally Complex Continuous Spectrum of Epitopes Dominated by Inhibitors of Factor VIII Activation", Blood, vol. 110, No. 13, pp. 4234-4242.
Meier, et al. (Jul. 2, 2004) "Determination of a High-Precision NMR Structure of the Minicollagen Cysteine Rich Domain from Hydra and Characterization of Its Disulfide Bond formation", FEBS Letters, vol. 569, No. 1-3, pp. 112-116.
Miljanich, G. P., et al. (Jan. 2004) "Ziconotide: Neuronal Calcium Channel Blocker for Treating Severe Chronic Pain", Current Medicinal Chemistry, vol. 11, No. 23, pp. 3029-3040.
Misenheimer, et al. (Dec. 16, 2005) "Biophysical Characterization of the Signature Domains of Thrombospondin-4 and Thrombospondin-2*", Journal of Biological Chemistry, vol. 280, No. 40, pp. 41229-41235.

Misenheimer, et al. (Oct. 4, 2001) "Disulfide Connectivity of Recombinant C-terminal Region of Human Thrombospondin 2", the Journal of Biological Chemistry, vol. 276, No. 49, pp. 45882-45887.
Mitraki, et al. (1989) "Protein Folding Intermediates and Inclusion Body formation", Nature Biotechnology, vol. 7, pp. 690-697.
Mize, et al. (2008) "Regulated Expression of Active Biotinylated G-Protein Coupled Receptors in Mammalian Cells", Protein Expression and Purification, vol. 57, No. 2, pp. 280-289.
Mogk, et al. (Sep. 2, 2002) "Mechanisms of Protein Folding: Molecular Chaperones and their Application in Biotechnology", ChemBioChem, vol. 3, Issue 9, pp. 807-814.
Morfini, Massimo (2008) "Secondary Prophylaxis with Factor IX Concentrates: Continuous Infusion", Blood Transfusion, vol. 6, Supplement 2, pp. s21-s25.
Mrsny, et al. (Feb. 15, 2002) "Bacterial Toxins as Tools for Mucosal Vaccination", Drug Discovery Today, vol. 7, Issue 4, pp. 247-258.
Murtuza, et al. (Mar. 23, 2004) "Transplantation of Skeletal Myoblasts Secreting An IL-1 Inhibitor Modulates Adverse Remodeling in Infarcted Murine Myocardium", Proceedings of the National Academy of Sciences of the United States of America, vol. 101, No. 12, pp. 4216-4221.
Narita, et al. (1998) "the Low-Density Lipoprotein Receptor-Related Protein (LRP) Mediates Clearance of Coagulation Factor Xa In Vivo", Blood, vol. 91, No. 2, pp. 555-560.
Narmoneva, et al. (Aug. 2005) "Self-Assembling Short Oligopeptides and the Promotion of Angiogenesis", Biomaterials, vol. 26, Issue 23, pp. 4837-4846.
NCBI (Jun. 11, 2015) "Serine Phosphatase RsbU, Regulator of Sigma Subunit [Amycolatopsis azurea]", Reference Sequence: WP_005158338.1, Available at URL: http://www.ncbi.nlm.nih.gov/protein/491300334?report=genbank&log$=protalign&blas t_rank=1&RID=3ERSOM7501R, 2 Pages.
NCBI "Probable Electron Transfer Flavoprotein Subunit Alpha, Mitochondrial [Galendromus Occidentalis]", NCBI Reference Sequence: XP_003746909.1 Retrieved at URL: https://www.ncbi.nlm.nih.gov/protein/391345263?report=genbank&log$=protalign&bla st_rank=1&RID=3ERSOM7501R, 3 pages.
Needleman, et al. (Mar. 1970) "A General Method Applicable to the Search for Similarities in the Amino Acid Sequence of Two Proteins", Journal of Molecular Biology, vol. 48, No. 3, pp. 443-453.
Newman et al., "Primatization" Of Recombinant Antibodies For Immunotherapy Of Human Diseases: A Macaque/Human Chimeric Antibody Against Human CD4, 1992, pp. 1455-1460.
Nielsen, et al. (Jul. 2003) "Di/Tri-Peptide Transporters as Drug Delivery Targets: Regulation of Transport Under Physiological and Patho-Physiological Conditions", Current Drug Targets, vol. 4, Issue 5, pp. 373-388.
Nielsen, et al. (Jul. 26, 2002) "Solution Structure of μ-Conotoxin PIIIA, a Preferential Inhibitor of Persistent Tetrodotoxin-sensitive Sodium Channels", the Journal of Biological Chemistry, vol. 277, pp. 27247-27255.
Noe, Da., et al. (Nov.-Dec. 1996) "A Mathematical Model of Coagulation Factor VIII Kinetics", Haemostasis, vol. 26, No. 6, pp. 289-303.
Nord, et al. (Aug. 1997) "Binding Proteins Selected from Combinatorial Libraries of an α-Helical Bacterial Receptor Domain", Nature Biotechnology, vol. 15, Issue 8, pp. 772-777.
Nuwiq [package insert], SE-112 75, Sweden: Octapharma, 2017.
O'Hara et al., "New challenges for an expanding generation of older persons with haemophilia", J Haem Pract 2022, 9(1), 13 pages.
O'Brien, et al. (Apr. 15, 1990) "Purification and Characterization of Factor VIII 372-Cys: A Hypofunctional Cofactor from A Patient with Moderately Severe Hemophilia A", Blood, vol. 75, No. 8, pp. 1664-1672.
O'Connell, et al. (Aug. 2, 2002) "Phage versus Phagemid Libraries for Generation of Human Monoclonal Antibodies", Journal of Molecular Biology, vol. 321, Issue 1, pp. 49-56.
Office Action mailed Apr. 16, 2013, in United States U.S. Appl. No. 12/806,005, Schellenberger, et al., filed on Aug. 2, 2010.
Office Action mailed Apr. 30, 2018, in United States U.S. Appl. No. 14/379,196 inventor Ekta Seth Chhabra, filed Aug. 15, 2014.

(56) References Cited

OTHER PUBLICATIONS

Office Action mailed Aug. 23, 2012, in United States U.S. Appl. No. 12/848,984, Schellenberger, et al., filed on Aug. 2, 2010.
Office Action mailed Aug. 7, 2018, for U.S. Appl. No. 14/379,192, inventor Ekta Seth Chhabra, filed Feb. 20, 2015.
Office Action mailed Dec. 12, 2017, in United States U.S. Appl. No. 14/371,948, Chhabra et al., filed on Jan. 12, 2013.
Office Action mailed Feb. 25, 2014, in U.S. Appl. No. 13/392,509, Schellenberger, et al., filed on Feb. 24, 2012.
Office Action mailed Jan. 14, 2014, in U.S. Appl. No. 12/796,650, Schellenberger, et al., filed on Jun. 8, 2010.
Office Action mailed Jan. 26, 2018, in U.S. Appl. No. 14/895,264 inventor Ekta Seth Chhabra, filed Dec. 2, 2015.
Office Action mailed Jul. 2, 2013 in U.S. Appl. No. 13/392,511, Schellenberger, V. et al., filed Jun. 27, 2012.
Office Action mailed Jun. 17, 2015, in U.S. Appl. No. 14/317,888, Schellenberger, et al., filed on Jun. 27, 2014.
Office Action mailed Jun. 18, 2020, for U.S. Appl. No. 16/154,310, inventor Ekta Seth Chhabra, filed Oct. 8, 2018.
Office Action mailed Jun. 21, 2013, in U.S. Appl. No. 12/806,004, Schellenberger, et al., filed on Aug. 2, 2010.
Office Action mailed Jun. 25, 2018 in U.S. Appl. No. 14/371,948 inventor Ekta Seth Chhabra, filed Jul. 11, 2014.
Office Action mailed Mar. 16, 2018, for U.S. Appl. No. 14/379,192, inventor Ekta Seth Chhabra, filed Feb. 20, 2015.
Office Action mailed Mar. 22, 2013, in U.S. Appl. No. 12/796,650, Schellenberger, et al., filed on Jun. 8, 2010.
Office Action mailed Mar. 9, 2016 in U.S. Appl. No. 14/218,524, filed Mar. 18, 2014.
Office Action mailed May 7, 2013, in U.S. Appl. No. 12/699,761, Schellenberger, et al., filed on Feb. 3, 2010.
Office Action mailed May 20, 2014 in U.S. Appl. No. 13/392,511, Schellenberger, V. et al., filed Jun. 27, 2012.
Office action mailed May 23, 2017, in U.S. Appl. No. 14/894,108, inventor Ekta Seth Chhabra, filed May 3, 2016.
Office Action mailed May 30, 2017, in U.S. Appl. No. 14/379,192, inventor Ekta Seth Chhabra, filed Feb. 20, 2015.
Office Action mailed Nov. 1, 2016, in U.S. Appl. No. 14/379,192, inventor Ekta Seth Chhabra, filed Feb. 20, 2015.
Office Action mailed Nov. 24, 2015 in U.S. Appl. No. 14/317,888, filed Jun. 27, 2014.
Office Action mailed Oct. 5, 2012, in United States U.S. Appl. No. 12/806,004, Schellenberger, et al., filed on Aug. 2, 2010.
Office Action mailed Oct. 20, 2014 in U.S. Appl. No. 13/392,511, Schellenberger, V. et al., filed Jun. 27, 2012.
Office Action mailed Sep. 11, 2013, in U.S. Appl. No. 12/848,984, Schellenberger, et al., filed on Aug. 2, 2010.
Office Action mailed Sep. 25, 2017, in U.S. Appl. No. 14/379,196, Kulman, filed on Feb. 15, 2013.
Office Action mailed Sep. 27, 2017, in U.S. Appl. No. 14/379,192, inventor Ekta Seth Chhabra, filed Feb. 20, 2015.
Office Action mailed Sep. 5, 2018, in U.S. Appl. No. 14/379,196 inventor Ekta Seth Chhabra, filed Aug. 15, 2014.
Ofir, et al. (May 2005) "Versatile Protein Microarray Based on Carbohydrate-Binding Modules", Proteomics, vol. 5, No. 7, pp. 1806-1814.
Ökten, et al. (Aug. 1, 2004) "Myosin VI Walks Hand-Over-Hand Along Actin", Nature Structural & Molecular Biology, vol. 11, pp. 884-887.
Oldenburg et al., Controlled, cross-sectional MRI evaluation of joint status in severe haemophilia A patients treated with prophylaxis vs on demand, Haemophilia, 2015, 21:171-179.
Oldenburg et al., Genetic risk factors for inhibitors to factors VIII and IX, Haemophilia, 2006,12(6): 15-22.
Oldenburg et al., Prophylaxis in adult patients with severe haemophilia A., Thrombosis Research, 2014, s33-s37.
O'Leary, et al. (Jan. 2005) "Solution Structure and Dynamics of a Prototypical Chordin-like Cysteine-rich Repeat (von Willebrand Factor Type C Module) from Collagen IIA", Journal of Biological Chemistry, vol. 279, No. 51, p. 53857-53866.
Orlova, et al. (Apr.-Jun. 2013) "Blood Clotting Factor VIII: From Evolution to therapy", Acta Naturae, vol. 5, No. 2, pp. 19-39.
Ormo, et al. (1996) "Crystal Structure of the Aequorea Victoria Green Fluorescent Protein", Science, vol. 273, No. 5280, pp. 1392-1395.
Osterud, et al. (Jul. 18, 1972) "Activation of the Coagulation Factor VII by Tissue Thromboplastin and Calcium", Biochemistry, vol. 11, No. 15, pp. 2853-2857.
Padiolleau-Lefevre, et al. (Mar. 2007) "Expression and Detection Strategies for an ScFv Fragment Retaining the Same High Affinity than Fab and Whole Antibody: Implications for therapeutic Use in Prion Diseases", Molecular Immunology, vol. 44, Issue 8, pp. 1888-1896.
Pallaghy, et al. (Nov. 20, 1993) "Three-dimensional Structure in Solution of the Calcium Channel Blocker ω-Conotoxin", Journal of Molecular Biology, vol. 234, Issue 2, pp. 405-420.
Pallaghy, et al. (Oct. 1994) "A Common Structural Motif Incorporating a Cystine Knot and a Triple-Stranded β-sheet in Toxic and Inhibitory Polypeptides", Protein Science, vol. 3, Issue 10, pp. 1833-1839.
Palmiter, et al. (1983) "Metallothionein-Human GH Fusion Genes Stimulate Growth of Mice", Science, vol. 222, No. 4625, pp. 809-814.
Pan, et al. (Dec. 1993) "Structure and Expression of Fibulin-2, A Novel Extracellular Matrix Protein with Multiple EGF-Like Repeats and Consensus Motifs for Calcium Binding", Journal of Cell Biology, vol. 123, Issue 5, pp. 1269-1277.
Panda, et al. (2003) "Bioprocessing of therapeutic Proteins from the Inclusion Bodies of *Escherichia coli*", Advances in Biochemical Engineering/Biotechnology, vol. 85, pp. 43-93.
Park, et al. (2010) "A Diagnostic Challenge: Mild Hemophilia B with Normal Activated Partial Thromboplastin Time", Blood Coagulation & Fibrinolysis, vol. 21, No. 4, pp. 368-371.
Partial European Search Report received for European Patent Application No. 12868427.1, mailed on Sep. 18, 2015, 7 Pages.
Patra, et al. (Mar. 2000) "Optimization of Inclusion Body Solubilization and Renaturation of Recombinant Human Growth Hormone from *Escherichia coli*", Protein Expression and Purification, vol. 18, Issue 2, pp. 182-192.
Pelegrini (Nov. 2005) "Plant Gamma-Thionins: Novel insights on The Mechanism of Action of a Multi-Functional Class of Defense Proteins", The International Journal of Biochemistry & Cell Biology, vol. 37, No. 11, pp. 2239-2253.
Pepinsky, et al. (Jun. 2001) "Improved Pharmacokinetic Properties of a Polyethylene Glycol-Modified form of Interferon-β-1a with Preserved In vitro Bioactivity", Journal of Pharmacology and Experimental therapeutics, vol. 297, vol. 3, pp. 1059-1066.
Petersen, et al. (Nov. 25, 2003) "the Dual Nature of Human Extracellular Superoxide Dismutase: one Sequence and Two Structures", Proceedings of the National Academy of Sciences of the United States of America, vol. 100, No. 24, pp. 13875-13880.
Pi, et al. (Feb. 2006) "Analysis of Expressed Sequence Tags from the Venom Ducts of Conus Striatus: Focusing on the Expression Profile of Conotoxins", Biochimie, vol. 88, Issue 2, pp. 131-140.
Pimanda, et al. (Nov. 2002) "the von Willebrand Factor-Reducing Activity of Thrombospondin-1 is Located in the Calcium-Binding/ C-Terminal Sequence and Requires a Free Thiol at Position 974", Blood, vol. 100, No. 8, pp. 2832-2838.
Pipe et al., "A global comparative field study to evaluate the factor VIII activity of efanesoctocog alfa by one-stage clotting and chromogenic substrate assays at clinical haemostasis laboratories", Haemophilia, Oct. 30, 2023, 1-10.
Pipe et al., "Efanesoctocog Alfa Activity Assessment with One-Stage Clotting (OSA) and Chromogenic Substrate (CSA) Factor VIII Assays", Abstract, Haemophilia, Feb. 5, 2023.
Pipe et al., "Efanesoctocog Alfa Activity Assessment with One-Stage Clotting (OSA) and Chromogenic Substrate (CSA) Factor VIII Assays", Poster, 16th Annual Congress of the European Association for Haemophilia and Allied Disorders, Feb. 7-10, 2023.
Pipe et al., "Characterization of a Genetically Engineered Inactivation-Resistant Coagulation Factor VIIIa", PNAS USA, Oct. 1997, vol. 94, pp. 11851-11856.

(56) References Cited

OTHER PUBLICATIONS

Pipe, S.W., "Functional roles of the factor VIII B domain", Haemophilia, vol. 15, 2009, pp. 1187-1196.
Pipe, Stewen W. (2005) "the Promise and Challenges of Bioengineered Recombinant Clotting Factors", Journal of Thrombosis and Haemostasis, vol. 3, No. 8, pp. 1692-1701.
Pokidysheva, et al. (2004) "the Structure of the Cys-Rich Terminal Domain of Hydra Minicollagen, Which Is Involved in Disulfide Networks of the Nematocyst Wall", the Journal of Biological Chemistry, vol. 279, No. 29, pp. 30395-30401.
Pool et al., High potency antihaemophilic factor concentrate prepared from cryoglobulin precipitate, Nature, 1964,203: 312.
Popkov, et al. (2004) "Isolation of Human Prostate Cancer Cell Reactive Antibodies Using Phage Display Technology", Journal of Immunological Methods, vol. 291, No. 1-2, pp. 137-151.
Prilusky, et al. (2005) "FoldIndex©: A Simple tool to Predict Whether A Given Protein Sequence is intrinsically Unfolded", Bioinformatics, vol. 21, No. 16, pp. 3435-3438.
Prinz, et al. (1997) "the Role of the Thioredoxin and Glutaredoxin Pathways in Reducing Protein Disulfide Bonds in the *Escherichia coli* Cytoplasm", the Journal of Biological Chemistry, vol. 272, No. 25, pp. 15661-15667.
Purvis et al., "Two Cys Residues Essential for Von Willebrand Factor Multimer Assembly in the Golgi", Proc Natl Acad Sci U S A, vol. 104 (40), pp. 15647-15652.
Puthenveetil, et al. (Nov. 2009) "Yeast Display Evolution of a Kinetically Efficient 13-Arnino Acid Substrate for Lipoic Acid Ligase", Journal of the American Chemical Society, vol. 131, No. 45, pp. 16430-16438.
Qi, et al. (2005) "Structural Features and Molecular Evolution of Bowman-Birk Protease Inhibitors and their Potential Application", Acta Biochimica Et Biophysica Sinica, vol. 37, No. 5, pp. 283-292.
Ramgren., A clinical and medico-social study of haemophilia in Sweden, Acta Med Scand Suppl., 1962,379: 111-190.
Rao, et al. (1985) "Activation of Human Factor VII During Clotting In Vitro", Blood, vol. 65, No. 1, pp. 218-226.
Rao, et al. (1998) "Molecular and Biotechnological aspects of Microbial Proteases", Microbiology and Molecular Biology Reviews: MMBR, vol. 62, No. 3, pp. 597-635.
Rasmussen, et al. (2002) "Tumor Cell-Targeting by Phage-Displayed Peptides", Cancer Gene therapy, vol. 9, No. 7, pp. 606-612.
Rawlings, et al. (2004) "Evolutionary Families of Peptidase Inhibitors", the Biochemical Journal, vol. 378, Part 3, pp. 705-716.
Rawlings, et al. (2008) "MEROPS: The Peptidase Database", Nucleic Acids Research vol. 36, Supplement 1, pp. D320-D325.
Rebay, et al. (1991) "Specific EGF Repeats of Notch Mediate Interactions with Delta and Serrate Implications for Notch as a Multifunctional Receptor", Cell, vol. 67, No. 4, pp. 687-699.
Reding et al., Safety and efficacy of BAY 94-9027, a prolonged-half-life factor VIII. J Thromb Haemost., 2017, Mar. 15(3): 411-419.
Rizzo, et al. (2010) "Fluorescent Protein Tracking and Detection", in Live Cell Imaging: A Laboratory Manual, pp. 3-34.
Roberge, et al. (2006) "Construction and Optimization of a Cc49-Based ScFv-Beta-Lactamase Fusion", Protein Engineering, Design & Selection: PEDS, vol. 19, No. 4, pp. 141-145.
Rodriguez-Santana et al., "Differential humanistic and economic burden of mild, moderate and severe haemophilia in european adults: a regression analysis of the CHESS II study", Orphanet Journal of Rare Diseases. 2022, 17(148), 10 pages.
Rodriguez-Santana et al., "Health-related quality of life, direct medical and societal costs among children with moderate or severe haemophilia in Europe: multivariable models of the CHESS-PAEDs study", Orphanet Journal of Rare Diseases, 2022, 17(150), 9 pages.
Rosa, et al. (2000) "Influence of the Co-Encapsulation of Different Non-Ionic Surfactants on the Properties of PLGA insulin-Loaded Micro spheres", Journal of Controlled Release, vol. 69, No. 2, pp. 283-295.

Rosen (1984) "Assay of Factor VIII:C with a chromogenic substrate", Scandinavian Journal of Haematology, vol. 33, Supplement 40, pp. 139-145.
Rosen, et al. (1985) "Clinical Application of a Chromogenic Substrate Method", Thrombosis and Haemostasis, vol. 54, No. 4, pp. 818-823.
Rosenfeld, et al. (1998) "Biochemical, Biophysical, and Pharmacological Characterization of Bacterially Expressed Human Agouti-Related Protein", Biochemistry, vol. 37, No. 46, p. 16041-16052.
Roussel, et al. (2001) "Complexation of Two Proteic insect inhibitors to the Active Site of Chymotrypsin Suggests Decoupled Roles for Binding and Selectivity", The Journal of Biological Chemistry, vol. 276, No. 42, pp. 38893-38898.
Rychkov, et al. (2007) "Joint Neighbors Approximation of Macromolecular Solvent Accessible Surface Area", Journal of Computational Chemistry, vol. 28, No. 12, pp. 1974-1989.
Saenko, et al. (1997) "the Acidic Region of the Factor VIII Light Chain and the C2 Domain Together form the High Affinity Binding Site for Von Willebrand Factor", Journal of Biological Chemistry, vol. 272, No. 29, pp. 18007-18014.
Saenko, et al. (1999) "Role of The Low-Density Lipoprotein-Related Protein Receptor in Mediation of Factor VIII Catabolism", The Journal of Biological Chemistry, vol. 274, No. 53, pp. 37685-37692.
Saenko, et al. (2005) "the Future of Recombinant Coagulation Factors", Journal of Thrombosis and Haemostasis, vol. 1, pp. 922-930.
Saenko, et al. (Jul. 2006) "Strategies Towards a Longer Acting Factor VIII", Haemophilia, vol. 12, Supplement 3, pp. 42-51.
Sahdev, et al. (Jan. 2008) "Production of Active Eukaryotic Proteins Through Bacterial Expression Systems: A Review of the Existing Biotechnology Strategies", Molecular and Cellular Biochemistry, vol. 307, No. 1-2, pp. 249-264.
Sakata, PAR-1 Thrombin Receptor Antagonist, 2012, pp. 47-50.
Salloum, et al. (Apr. 2009) "Anakinra in Experimental Acute Myocardial Infarction—Does Dosage or Duration of Treatment Matter?", Cardiovascular Drugs and therapy Sponsored by the International, Society of Cardiovascular Pharmacotherapy, vol. 23, No. 2, pp. 129-135.
Sambrook et al., Molecular Cloning: A Laboratory Manual, 1989, Second Edition, Cold Spring Harbor Laboratory Press, United States.
Sandberg et al., "Structural and Functional Characterization of B-Domain Deleted Recombinant Factor VIII", Seminars in Hematology, Apr. 2001, vol. 38, No. 2, Suppl. 4, pp. 4-12.
Sanofi, "Capital Markets Day, Play to Win", Presentation Slides, Dec. 10, 2019.
Sanofi, "Press Release: Efanesoctocog alfa met primary and key secondary endpoints in pivotal study in hemophilia A, demonstrating superiority to prior factor prophylaxis treatment", Mar. 9, 2022, 3 pages.
Sanofi, "Press Release: FDA approves once-weekly aLTUVIIIO™, a new class of factor VIII therapy for hemophilia A that offers signiciant bleed protection. This positive event triggers impairment erversal, impacting 2022 IFRS net income; no change on business net income (non-IFRS)", Feb. 24, 2023, 2 pages.
Sanofi, "Press Release: FDA grants priority review to efanesoctocof alfa for people with hemophilia A", Aug. 30, 2022, 3 pages.
Sanofi, A Phase 1/2a, Open-Label, Dose-Escalation Study to Determine the Safety, Tolerability, and Pharmacokinetisc of a Single Intravenous Injection of rFVIIIFc-VWF-XTEN (BIVV001) in Previously Treated Adults with Severe Hemophilia A, Model Patient Information Sheet and Informed Consent Form, Protocol No. 242HA101, EudraCT No. 2017-001140-34, Version 3, Jun. 13, 2017, 12 pages.
Sanofi, A Phase 3 Open-Label Multicenter Study of the Safety, Efficacy, and Pharmacokinetics of Intravenous Recombinant Coagulation Factor VIII Fc-von Willebrand Factor-XTEN Fusion Protein (rFVIIIFc-VWF-XTEN; BIVV001) in Previously Treated Patients under 12 Years of Age With Severe Hemophilia A, Core Study Information and Informed Consent Form, Protocol No. EFC16293, Nov. 6, 2019.

(56) References Cited

OTHER PUBLICATIONS

Sanofi, Hemophilia Investor Event Presentation slides, Jul. 13, 2022, 48 pages.
Sanofi, 'Media Update: Sanofi to present new clinical data reinforcing novel therapies across rare blood disorders at ASH 2022, Nov. 30, 2022, 4 pages.
Sanofi, R&D Investor Event: Lead with innovation, Presentation slides, Jun. 23, 2020, 82 pages.
Scandella, et al. (1989) "Localization of Epitopes for Human Factor VIII Inhibitor Antibodies by Immunoblotting and Antibody Neutralization", Blood, vol. 74, No. 5, pp. 1618-1626.
Scandella, et al. (Aug. 1, 1988) "Epitope Mapping of Human Factor VIII Inhibitor Antibodies by Deletion Analysis of Factor VIII Fragments Expressed in *Escherichia coli*", Proceedings of the National Academy of Sciences, vol. 85, No. 16, pp. 6152-6156.
Schatz, P. J. (1993) "Use of Peptide Libraries to Map the Substrate Specificity of a Peptide-Modifying Enzyme: A 13 Residue Consensus Peptide Specifies Biotinylation In *Escherichia coli*", Biotechnology, vol. 11, No. 10, pp. 1138-1143.
Schellenberger, et al. (1993) "Analysis of Enzyme Specificity by Multiple Substrate Kinetics", Biochemistry, vol. 32, No. 16, pp. 4344-4348.
Schmidt, et al. (2003) "Structure-Function Relationships in Factor IX and Factor IXa", Trends in Cardiovascular Medicine, vol. 13, No. 1, pp. 39-45.
Scholle, et al. (2005) "Efficient Construction of a Large Collection of Phage-Displayed Combinatorial Peptide Libraries", Combinatorial Chemistry High Throughput Screening, vol. 8. Number 6, pp. 545-551.
Schulte, et al., "Prolonged In-Vivo Half-Life of FVIIa by Fusion to Albumin", Blood, 2007, vol. 110, No. 11, Abstract 3142, American Society of Hematology.
Schulte, S (2011) "Pioneering Designs for Recombinant Coagulation Factors", Thrombosis Research, vol. 128, Supplement 1, pp. S9-S12.
Schultz-Cherry, et al. (1994) "The Type 1 Repeats of Thrombospondin 1 Activate Latent Transforming Growth Factor-Beta", the Journal of Biological Chemistry, vol. 269, No. 43, pp. 26783-26788.
Schultz-Cherry, et al. (1995) "Regulation of Transforming Growth Factor-Beta Activation by Discrete Sequences of Thrombospondin 1", Journal of Biological Chemistry, vol. 270, No. 13, pp. 7304-7310.
Schulz, et al. (2005) "Potential of Nir-Ft-Raman Spectroscopy in Natural Carotenoid Analysis", Biopolymers, vol. 77, No. 4, pp. 212-221.
Shaikh, et al. "Examining the impact of haemophilia treatment on health-related quality of life", Haemophilia, 2022, 28(5): 796-805.
Shapiro et al., "Recombinant factor VIII Fc fusion protein: extended-interval dosing maintains low bleeding rates and correlates with von Willebrand factor levels", Journal of Thrombosis and Haemostasis, Nov. 2014, 12(11): 1788-1800.
Sheffield, et al. (2004) "Effects of Genetic Fusion of Factor IX to Albumin on In Vivo Clearance in Mice and Rabbits", British Journal of Haematology, vol. 126, No. 4, pp. 565-573.
Shen, et al. (1998) "A Type I Peritrophic Matrix Protein from the Malaria Vector Anopheles Gambiae Binds to Chitin Cloning, Expression, and Characterization", Journal of Biological Chemistry, vol. 273, No. 28, pp. 17665-17670.
Shima, et al. (1993) "A Factor VIII Neutralizing Monoclonal Antibody and A Human Inhibitor Alloantibody Recognizing Epitopes in The C2 Domain inhibit Factor VIII Binding to Von Willebrand Factor and to Phosphatidylserine", Journal of Thrombosis and Haemostasis, vol. 69, No. 3, pp. 240-246.
Shimomura, et al. (1962) "Extraction, Purification and Properties of Aequorin, a Bioluminescent Protein from the Luminous Hydromedusan, Aequorea", Journal of Cellular and Comparative Physiology, vol. 59, pp. 223-239.
Shukla et al., "Interaction of Arginine with Proteins and the Mechanism by Which It Inhibits Aggression", J Phys Chem B., 2010, 114: 13426-13438.

Sidhu, et al. (2000) "Phage Display for Selection of Novel Binding Peptides", Methods in Enzymology, vol. 328, No., pp. 333-363.
Silverman, et al. (2005) "Multivalent Avimer Proteins Evolved by Exon Shuffling of a Family of Human Receptor Domains", Nature Biotechnology, vol. 23, No. 12, pp. 1556-1561.
Simonet, et al. (2002) "Structural and Functional Properties of a Novel Serine Protease Inhibiting Peptide Family in Arthropods", Comparative Biochemistry and Physiology. Part B, Biochemistry & Molecular Biology, vol. 132, No. 1, pp. 247-255.
Singh, et al. (Dec. 2001) "ProPred: Prediction of HLA-DR Binding Sites", Bioinformatics, vol. 17, No. 12, pp. 1236-1237.
Skinner, et al. (1989) "Purification and Characterization of Two Classes of Neurotoxins from the Funnel Web Spider, Agelenopsis Aperta", the Journal of Biological Chemistry, vol. 264, No. 4, pp. 2150-2155.
Smith, et al. (1988) "Single-Step Purification of Polypeptides Expressed in *Escherichia coli* as Fusions with Glutathione S-Transferase", Gene, vol. 67, No. 1, pp. 31-40.
Smith, et al. (1997) "Phage Display", Chemical Reviews, vol. 97, vol. 2, pp. 391-410.
So, et al. (2001) "Contribution of Conformational Stability of Hen Lysozyme to Induction of Type 2 T-Helper Immune Responses", Immunology, vol. 104, No. 3, pp. 259-268.
Soucie et al., The frequency of joint hemorrhages and procedures in nonsevere hemophilia A vs B, Blood Adv., 2018,2: 2136-2144.
Southern, et al. (1982) "Transformation of Mammalian Cells to Antibiotic Resistance with a Bacterial Gene Under Control of the Sv40 Early Region Promoter", Journal of Molecular and Applied Genetics 1, No. 4, pp. 327-341.
Spencer, et al. (2011) "Lentiviral Vector Platform for Production of Bioengineered Recombinant Coagulation Factor VIII", Molecular therapy, vol. 19, No. 2, pp. 302-309.
Srivastava, et al. (2005) "Application of Self-Assembled Ultra-Thin Film Coatings to Stabilize Macromolecule Encapsulation in Alginate Micro spheres", Journal of Microencapsulation, vol. 22, No. 4, pp. 397-411.
Staber et al., " Efanesoctocog alfa half-life and clearance are independent of von Willebrand factor (VWF) in severe hemophilia A: a post hoc analysis from Phase 1/2a studies", Abstract, Blood 2022 Congress: Sep. 11-14, 2022, Sydney.
Staber et al., " Efanesoctocog alfa half-life and clearance are independent of von Willebrand factor (VWF) in severe hemophilia A: a post hoc analysis from Phase 1/2a studies", Poster, Blood 2022 Congress: Sep. 11-14, 2022, Sydney.
Staber et al., "Efanesoctocog alfa Exhibits Von Willebrand Factor-Independent Pharmacokinetics in Severe Hemophilia A: A Post Hoc Analysis From Phase 1/2a Studies", Abstract, THSNA 2022 Summit Abstract Proceedings, American Journal of Hematology, E104.
Staber et al., "Efanesoctocog alfa Exhibits Von Willebrand Factor-Independent Pharmacokinetics in Severe Hemophilia A: A Post Hoc Analysis From Phase 1/2a Studies", Presentation Slides, THSNA 2022 Summit Abstract Proceedings, 14 pages.
Staber et al., "Efanesoctocog Alfa Half-Life and Clearance Are Independent of von Willebrand Factor in Severe Hemophilia A: A Post Hoc Analysis From Phase 1/2a Studies", 44th Congress of the Japanese Society on Thrombosis and Hemostasis, Jun. 23-25, 2022.
Staber et al., "Efanesoctocog Alfa Half-Life and Clearance Are Independent of von Willebrand Factor in Severe Hemophilia A: A Post Hoc Analysis From Phase 1/2a Studies", Efanesoctocog alfa half-life and VWF independence Abstract—Encore, NHF 2022 Congress: Aug. 25-27, 2022, Houston & Virtual.
Staber et al., "Efanesoctocog Alfa Half-Life and Clearance Are Independent of von Willebrand Factor in Severe Hemophilia A: A Post Hoc Analysis From Phase 1/2a Studies", Presentation Slides, NHF 7th Annual Bleeding Disorders Conference (BDC) 2022, Aug. 25-27, 2022.
Staber et al., "Efanesoctocog Alfa Half-Life and Clearance Are Independent of von Willebrand Factor in Severe Hemophilia A: A Post Hoc Analysis From Phase 1/2a Studies", Presentation Slides, The 44th Congress of the Japanese Society on Thrombosis and Hemostasis, 13 pages.
Staber et al., "The 44th Congress of the Japanese Society on Thrombosis and Hemostasis: Abstract Submission Form", 2022.

(56) References Cited

OTHER PUBLICATIONS

Stamos, et al. (2004) "Crystal Structure of the HGF Beta-Chain in Complex with the Sema Domain of the Met Receptor", The EMBO Journal, vol. 23, No. 12, pp. 2325-2335.
Steipe, et al. (Jul. 15, 1994) "Sequence Statistics Reliably Predict Stabilizing Mutations in a Protein Domain", Journal of Molecular Biology, vol. 240, No. 3, pp. 188-192.
Stemmer, et al. (1995) "Single-Step Assembly of a Gene and Entire Plasmid from Large Numbers of Oligodeoxyribonucleotides", Gene, vol. 164, No. 1, pp. 49-53.
Stemmer, W. P. (1994) "Rapid Evolution of a Protein in Vitro by DNA Shuffling", Nature, vol. 370, No. 6488, pp. 389-0391.
Stickler, et al. (2003) "Human Population-Based Identification of CD4+ T-Cell Peptide Epitope Determinants", Journal of Immunological Methods, vol. 281, No. 1-2, pp. 95-108.
Stites, et al. (1995) "Empirical Evaluation of the Influence of Side Chains on the Conformational Entropy of the Polypeptide Backbone", Proteins: Structure, Function, and Bioinformatics, vol. 22, No. 2, pp. 132-140.
Stoll, et al. (2000) "Mechanistic Analysis of Carrier-Mediated Oral Delivery of Protein therapeutics", Journal of Controlled Release, vol. 64, No. 1-3, pp. 217-228.
Sturniolo, et al. (1999) "Generation of Tissue-Specific and Promiscuous HLA Ligand Database Using DNA Microarrays and Virtual HLA Class II Matrices", Nature Biotechnology, vol. 17, No. 6, pp. 555-561.
Subramani, et al. (1981) "Expression of the Mouse Dihydrofolate Reductase Complementary Deoxyribonucleic Acid in Simian Virus 40 Vectors", Molecular and Cellular Biology, vol. 1, No. 9, pp. 854-864.
Suetake, et al. (2000) "Chitin-Binding Proteins in Invertebrates and Plants Comprise a Common Chitin-Binding Structural Motif", the Journal of Biological Chemistry, vol. 275, No. 24, pp. 17929-17932.
Suetake, et al. (2002) "Production and Characterization of Recombinant Tachycitin, the Cys-Rich Chitin-Binding Protein", Protein Engineering, vol. 15, No. 9, pp. 763-769.
Summers, et al. (1978) "Baculovirus Structural Polypeptides", Virology, vol. 84, No. 2, pp. 390-402.
Supplementary European Search Report received for European Patent Application No. 12868427, mailed on Sep. 18, 2015, 8 pages.
Tagalakis et al., The epidemiology of peripheral vein infusion thrombophlebitis: A critical review, Am J Med., 2002, 113(2): 146-51.
Takahashi, et al. (2000) "Solution Structure of Hanatoxin1, a Gating Modifier of Voltage-Dependent K (+) Channels: Common Surface Features of Gating Modifier Toxins", Journal of Molecular Biology, vol. 297, No. 3, pp. 771-780.
Takenobu, et al. (2002) "Development of P53 Protein Transduction Therapy Using Membrane-Permeable Peptides and the Application to oral Cancer Cells", Molecular Cancer therapeutics, vol. 1, No. 12, pp. 1043-1049.
Tam, et al. (1998) "A Biomimetic Strategy in the Synthesis and Fragmentation of Cyclic Protein", Protein Science, vol. 7, No. 7, pp. 1583-1592.
Tavladoraki, et al. (1999) "A Single-Chain Antibody Fragment is Functionally Expressed in the Cytoplasm of Both *Escherichia coli* and Transgenic Plants", European Journal of Biochemistry/FEBS, vol. 262, No. 2, pp. 617-624.
Tax, et al. (1994) "Sequence of C. Elegans Iag-2 Reveals a Cell-Signalling Domain Shared with Delta and Serrate of Drosophila", Nature, vol. 368, No. 6467, pp. 150-154.
Terpe, K. (2003) "Overview of Tag Protein Fusions: from Molecular and Biochemical Fundamentals to Commercial Systems", Applied Microbiology and Biotechnology, vol. 60, No. 5, pp. 523-533.
Thai, et al. (2004) "Antigen Stability Controls Antigen Presentation", the Journal of Biological Chemistry, vol. 279, No. 48, pp. 50257-50266.
Thomas, Patrica S. (1980) "Hybridization of Denatured RNA and Small DNA Fragments Transferred to Nitrocellulose", Proceedings of the National Academy of Sciences vol. 77, No. 9, pp. 5201-5205.
Thornburg et al., Treatment adherence in hemophilia, Patient Preference and Adherence, 2017,11: 1677-1686.
Tolkatchev, et al. (2000) "Design and Solution Structure of a Well-Folded Stack of Two Beta-Hairpins Based on the Amino-Terminal Fragment of Human Granulin A", Biochemistry, vol. 39, No. 11, pp. 2878-2886.
Torres, et al. (1999) "Solution Structure of a Defensin-Like Peptide from Platypus Venom", the Biochemical Journal, vol. 341, Part 3, pp. 785-794.
Towfighi, et al. (2005) "Comparative Measurement of Anti-Factor VIII Antibody by Bethesda Assay and ELISA Reveals Restricted Isotype Profile and Epitope Specificity", Acta Haematologica, vol. 4, No. 2, pp. 84-90.
Tuddenham, et al. (1982) "Response to Infusions of Polyelectrolyte Fractionated Human Factor VIII Concentrate in Human Haemophilia A and Von Willebrand's Disease", British Journal of Haematology, vol. 52, No. 2, pp. 259-267.
Tur, et al. (2003) "Novel Approach for Immunization, Screening and Characterization of Selected ScFv Libraries Using Membrane Fractions of Tumor Cells", International Journal of Molecular Medicine, vol. 11, No. 4, pp. 523-527.
Turacek et al., Structure and Function of a Recombinant von Willebrand Factor Drug Candidate, Seminars in Thrombosis and Hemostasis, 2010, 36(5): 510-521.
U.S. Appl. No. 14/466,567 to Schellenberger et al., filed Aug. 22, 2014 (Not Published).
U.S. Appl. No. 14/517,680 to Schellenberger et al., filed Oct. 17, 2014 (Not Published).
UniProtKB (Dec. 16, 2014) "ELNE_HUMAN", UniProtKB, Accession No. P08246; Retrieved from http://www.uniprot.org/uniprot/P08246, 19 pages.
UniProtKB (Dec. 16, 2014) "FA10_HUMAN", UniProtKB, Accession No. P00742, Retrieved from https://www.uniprot.org/uniprot/P00742, 25 pages.
UniProtKB (Dec. 16, 2014) "FA11_HUMAN", UniProtKB, Accession No. P03951, Retrieved from https://www.uniprot.org/uniprot/P03951, 22 pages.
UniProtKB (Dec. 16, 2014) "FA12_HUMAN", UniProtKB, Accession No. P00748; Retrieved from https://www.uniprot.org/uniprot/P03951, 14 pages.
UniProtKB (Dec. 16, 2014) "FA7_HUMAN", UniProtKB, Accession No. P08709, Retrieved from https://www.uniprot.org/uniprot/P08709, 27 pages.
UniProtKB (Dec. 16, 2014) "FA9_HUMAN", UniProtKB, Accession No. P00740, 26 Pages.
UniProtKB (Dec. 16, 2014) "KLKB1_HUMAN", UniProtKB, Accession No. P03952; Retrieved from https://www.uniprot.org/uniprot/P03952, 11 pages.
UniProtKB (Dec. 16, 2014) "MMP12_HUMAN", UniProtKB, Accession No. P39900, Retrieved from https://www.uniprot.org/uniprot/P39900, 12 pages.
UniProtKB (Dec. 16, 2014) "MMP17_HUMAN", UniProtKB, Accession No. Q9ULZ9, Retrieved from https://www.uniprot.org/uniprot/Q9ULZ9, 11 Pages.
UniProtKB (Dec. 16, 2014) "MMP20 Human", UniProtKB, Accession No. O60882, Retrieved from https://www.uniprot.org/uniprot/O60882, 10 pages.
UniProtKB (Dec. 16, 2014) "THRB_HUMAN", accession No. P00734, accessed at http://www.uniprot.org/uniprot/P00734, 42 pages.
UniProtKB (Dec. 16, 2014,) "MMP13_HUMAN", UniProtKB, Accession No. P45452; Retrieved from https://www.uniprot.org/uniprot/P45452, 15 pages.
Urlaub, et al. (Jul. 1980) "Isolation of Chinese Hamster Cell Mutants Deficient in Dihydrofolate Reductase Activity", Proceedings of the National Academy of Sciences of the United States of America, vol. 77, No. 7, pp. 4216-4220.
Uttamapinant, et al. (Jun. 2010) "Fluorophore Ligase for Site-Specific Protein Labeling Inside Living Cells", Proceedings of the National Academy of Sciences, vol. 107, No. 24, pp. 10914-10919.
Uversky, et al. (2000) "Why Are "Natively Unfolded" Proteins Unstructured Under Physiologic Conditions?", Proteins: Structure, Function and Genetics, vol. 41, No. 3, pp. 415-427.

(56) References Cited

OTHER PUBLICATIONS

Valente, et al. (2006) "Optimization of the Primary Recovery of Human Interferon Alpha2B from *Escherichia coli* Inclusion Bodies", Protein Expression and Purification, vol. 45, No. 1, pp. 226-234.
Valentino et al., A randomized comparison of two prophylaxis regimens and a paired comparison of on-demand and prophylaxis treatments in hemophilia A management, J Thromb Haemost., 2012,10(3):359-367.
Valjakka, et al. (1998) "Unreliability of the Chou-Fasman Parameters in Predicting Protein Secondary Structure", Protein Engineering, vol. 11, No. 5, pp. 345-348.
Van Den Hooven, et al. (2001) "Disulfide Bond Structure of the AVR9 Elicitor of the Fungal Tomato Pathogen Cladosporium Fulvum: Evidence for a Cystine Knot", Biochemistry, vol. 40, No. 12, pp. 3458-3466.
Van Genderen et al., Measuring patients' perceptions on their functional abilities: validation of the Haemophilia Activities List, Haemophilia Jan. 2006, 12(1):36-46.
Van Vlijmen, et al. (2004) "A Novel Database of Disulfide Patterns and Its Application to the Discovery of Distantly Related Homologs", Journal of Molecular Biology, vol. 335, No. 4, pp. 1083-1092.
Vanhercke, et al. (2005) "Reducing Mutational Bias in Random Protein Libraries", Analytical Biochemistry, vol. 339, No. 1, pp. 9-14.
Vardar, et al. (2003) "Nuclear Magnetic Resonance Structure of a Prototype Lin12-Notch Repeat Module from Human Notch1", Analytical Biochemistry, vol. 339, No. 1, pp. 7061-7067.
Venkatachalam, et al. (1969) "Conformation of Polypeptide Chains", Annual Review of Biochemistry, vol. 38, pp. 45-82.
Venkateswarlu, Divi (Feb. 25, 2010) "Structural Investigation of Zymogenic and Activated forms of Human Blood Coagulation Factor VIII: A Computational Molecular Dynamics Study", BMC Structural Biology vol. 10, Article No. 7, 20 Pages.
Ventura, S. (2005) "Sequence Determinants of Protein Aggregation: Tools to Increase Protein Solubility", Microbial Cell Factories, vol. 4, No. 1, 11 Pages.
Verbruggen, et al. (1995) "the Nijmegen modification of the Bethesda assay for factor VIII:C inhibitors: improved specificity and reliability", Journal of Thrombosis and Haemostasis, vol. 73, No. 2, pp. 247-251.
Vestergaard-Bogind, et al. (1985) "Single-File Diffusion Through the Ca2+-Activated K+ Channel of Human Red Cells", the Journal of Membrane Biology, vol. 88, No. 1, pp. 67-75.
Voisey, et al. (2002) "Agouti: from Mouse to Man, from Skin to Fat", Pigment Cell Research Sponsored by the European Society for Pigment Cell Research and the International Pigment Cell Society, vol. 15, No. 1, pp. 10-18.
Von Drygalski et al., "Change in Hemophilia Joint Health Score (HJHS) During the Phase 3 XTEND-1 Study of Efanesoctocog Alfa in Patients with Severe Hemophilia A", Eahad Oral Presentation Script, 16th Annual Congress of the European Association for Haemophilia and Allied Disorders, Feb. 7-10, 2023.
Von Drygalski et al., "Change in Hemophilia Joint Health Score (HJHS) During the Phase 3 XTEND-1 Study of Efanesoctocog Alfa in Patients with Severe Hemophilia A", Presentation Slides, 16th Annual Congress of the European Association for Haemophilia and Allied Disorders, Feb. 7-10, 2023.
Von Drygalski et al., "Consensus on Outcomes of Physical Functional and Activites for Persons with Haemophilia: Results from the IPOP Study", Haemophilia, 2023, 14-15.
Von Drygalski et al., "Efanesoctocog Alfa Prophylaxis for Patients with Severe Hemophilia A", The New England Journal of Medicine, Jan. 26, 2023, 388(4): 310-318.
Von Drygalski et al., "Efficacy, Safety, and Pharmacokinetics of Once-Weekly Efanesoctocog Alfa (BIVV001) Prophylaxis in Previously Treated Patients With Severe Hemophilia A: Results From the Phase 3 XTEND-1 Study", Abstract, ISTH 2022 Congress Meeting, 3 pages.
Von Drygalski et al., "Efficacy, Safety, and Pharmacokinetics of Once-Weekly Efanesoctocog Alfa (BIVV001) Prophylaxis in Previously Treated Patients With Severe Hemophilia A: Results From the Phase 3 XTEND-1 Study", Presentation Slides, ISTH 2022 Congress Meeting, London, England, 16 pages.
Von Mackensen S, Gringeri A & the Haem-A-QoL study Group. Health-related Quality of Life in Adult Patients with Haemophilia—Assessment with a New Disease-specific Questionnaire (Haem-A-QoL). Journal Of Thrombosis and Haemostasis. 2005;3(Sup1):P0813.
Vranken, et al. (1999) "A 30-Residue Fragment of the Carp Granulin-1 Protein Folds into a Stack of Two Beta-Hairpins Similar to That Found in the Native Protein", the Journal of Peptide Research: official Journal of the American Peptide Society, vol. 53, No. 5, pp. 590-597.
Wagenvoord, et al. (1989) "Development of a Simple Chromogenic Factor VIII Assay for Clinical Use", Haemostasis, vol. 19, No. 4, pp. 196-204.
Walker, et al. (2003) "Using Protein-Based Motifs to Stabilize Peptides", the Journal of Peptide Research, vol. 62, No. 5, pp. 214-226.
Wang, et al. (1988) "Parenteral formulations of Proteins and Peptides: Stability and Stabilizers", Journal of Parenteral Science and Technology, vol. 42, pp. S2-S24.
Wang, et al. (1999) "Structure-Function Studies of Omega-Atracotoxin, a Potent Antagonist of Insect Voltage-Gated Calcium Channels", European Journal of Biochemistry/ FEBS, vol. 264, No. 2, pp. 488-494.
Ward, et al. (Oct. 12, 1989) "Binding Activities of a Repertoire of Single Immunoglobulin Variable Domains Secreted from *Escherichia coli*", Nature, vol. 341, No. 6242, pp. 544-546.
Wasley, et al. (Apr. 25, 1993) "PACE/Furin can Process the Vitamin K-Dependent Pro-Factor IX Precursor within the Secretory Pathway", the Journal of Biological Chemistry, vol. 268, No. 12, pp. 8458-8465.
Watters, et al. (1997) "An Optimized Method for Cell-Based Phage Display Panning", Immunotechnology, vol. 3, No. 1, pp. 21-29.
Weimer, et al. (Apr. 2008) "Prolonged In-Vivo Half-Life of Factor VIIa by Fusion to Albumin", Thrombosis and Haemostasis, vol. 99, No. 04, pp. 659-667.
Weiss, et al. (1977) "Stabilization of Factor VIII in Plasma by the Von Willebrand Factor: Studies on Posttransfusion and Dissociated Factor VIII and In Patients with Von Willebrand's Disease", the Journal of Clinical Investigation, vol. 60, No. 2, pp. 390-404.
Weiss, et al. (1995) "A Cooperative Model for Receptor Recognition and Cell Adhesion: Evidence from the Molecular Packing In the 1.6-A Crystal Structure of the Pheromone Er-1 from the Ciliated Protozoan Euplotes Raikovi", Proceedings of the National Academy of Sciences of the United States of America, vol. 92, No. 22, pp. 10172-10176.
Wentzel, et al. (1999) "Sequence Requirements of the GPNG Beta-Tum of the Ecballium Elaterium Trypsin Inhibitor Ii Explored by Combinatorial Library Screening", the Journal of Biological Chemistry, vol. 274, No. 30, pp. 21037-21043.
Werle, et al. (2006) "the Potential of Cystine-Knot Microproteins As Novel Pharmacophoric Scaffolds in Oral Peptide Drug Delivery", Journal of Drug Targeting, vol. 14, No. 3, pp. 137-146.
Werther, et al. (1996) "Humanization of An Anti-Lymphocyte Function-associated Antigen (LFA)-1 Monoclonal Antibody and Reengineering of the Humanized Antibody for Binding to Rhesus Lfa-1", Journal of Immunology, vol. 157, No. 1, pp. 4986-4995.
Weyand et al., "Treatment of Bleeding Episodes with Efanesoctocog Alfa in Patients with Severe Haemophilia A in the Phase 3 XTEND-1 Study", Abstract, Haemophilia, 136-137.
Weyand et al., "Treatment of Bleeding Episodes with Efanesoctocog Alfa in Patients with Severe Haemophilia A in the Phase 3 XTEND-1 Study", Poster, 16th Annual Congress of the European Association for Haemophilia and Allied Disorders, Feb. 7-10, 2023.
WFH, 2012, World Federation of Hemophilia, Guidelines for the management of hemophilia, 2nd edition.
White, et al. (1989) "Factor VIII Gene and Hemophilia A", Blood, vol. 73, No. 1, pp. 1-12.

(56) References Cited

OTHER PUBLICATIONS

Whitlow, et al. (1994) "Multivalent Fvs: Characterization of Single-Chain Fv Oligomers and Preparation of a Bispecific Fv", Protein Engineering, vol. 7, No. 8, pp. 1017-1026.
Williams, What Are Platelets and Why Are They Important? Johns Hopkins Medicine, Obtained from url: https://www.hopkinsmedicine.org/health/conditions-and-diseases/what-are-platelets-and-why-are-they-important. (Year: 2010).
Wilson et al., "Impact of Efanesoctocog Alfa Prophylaxis on Pain in Previously Treated Patients with Hemophilia A: Results from the XTEND-1 Phase 3 Study", Abstract, HTRS Mar. 10-12, 2023, Orlando, Florida.
Wilson et al., "Efficacy of Efanesoctocog Alfa on Physical Functioning: Results From the XTEND-1 Phase 3 Clinical Trial in Previously Treated Patients With Hemophilia A", Abstract, HTRS Mar. 10-12, 2023, Orlando, Florida, 5 pages.
Wilson et al., "Efficacy of Efanesoctocog Alfa on Physical Functioning: Results From the XTEND-1 Phase 3 Clinical Trial in Previously Treated Patients With Hemophilia A", Presentation Slides, HTRS Mar. 10-12, 2023, Orlando, Florida, 14 Pages.
Winter, et al. (Jun. 1, 1993) "Humanized Antibodies", Immunology Today, vol. 14, No. 6, pp. 243-246.
Wittrup, K. D. (2001) "Protein Engineering by Cell-Surface Display", Current Opinion in Biotechnology, vol. 12, No. 4, pp. 395-399.
Woof, et al. (Feb. 2004) "Human Antibody-Fc Receptor Interactions Illuminated by Crystal Structures", Nature Reviews Immunology, vol. 4, pp. 89-99.
World Federation of Hemophilia, World Federation of Hemophilia Report on the Annual Global Survey 2017. Montreal, Quebeck: World Federation of Hemophilia, Oct. 2018. Available at: http://www1.wfh/org/publications/files/pdf-1714.pdf.
Worn, et al. (2000) "Correlation Between In Vitro Stability and In Vivo Performance of Anti-Gcn4 Intrabodies As Cytoplasmic Inhibitors", the Journal of Biological Chemistry, vol. 275, No. 4, pp. 2795-2803.
Worn, et al. (2001) "Stability Engineering of Antibody Single-Chain Fv Fragments", Journal of Molecular Biology, vol. 305, No. 5, pp. 989-1010.
Wrammert, et al. (May 2008) "Rapid Cloning of High-Affinity Human Monoclonal Antibodies Against Influenza Virus", Nature, vol. 453, No. 7195, pp. 667-671.
Wright, et al. (1999) "Intrinsically Unstructured Proteins: Re-Assessing the Protein Structure-Function Paradigm", Journal of Molecular Biology, vol. 293, No. 2, pp. 321-331.
Xia et al., "A Physiologically Based Pharmacokinetic (PBPK) Model to Characterize BIVV001 Activity, A New Class of Factor VIII (FVIII) With High Sustained Factor Activity", Poster, 14th Annual Congress of the European Association for Haemophilia and Allied Disorders, Feb. 3-5, 2021, 4 pages.
Xiong, et al. (2004) "A Novel Adaptation of the Integrin Psi Domain Revealed from Its Crystal Structure", the Journal of Biological Chemistry, vol. 279, No. 39, pp. 40252-40254.
Xu, et al. (2000) "Solution Structure of Bmp02, A New Potassium Channel Blocker from the Venom of the Chinese Scorpion Buthus Martensi Karsch", Biochemistry, vol. 39, No. 45, pp. 13669-13675.
Xyntha [package insert], Philadelphia, PA: Wyeth Pharmaceuticals Inc, 2015.
Yamazaki, et al. (2003) "A Possible Physiological Function and the Tertiary Structure of a 4-Kda Peptide in Legumes", European Journal of Biochemistry / FEBS, vol. 270, No. 6, pp. 1269-1276.
Yang, et al. (1995) "CDR Walking Mutagenesis for the Affinity Maturation of a Potent Human Anti-Hiv-1 Antibody into the Picomolar Range", Journal of Molecular Biology, vol. 254, No. 3, pp. 392-403.
Yang, et al. (1999) "Intestinal Peptide Transport Systems and oral Drug Availability", Pharmaceutical Research, vol. 16, No. 9, pp. 1331-1343.
Yang, et al. (2003) "Tailoring Structure-Function and Pharmacokinetic Properties of Single-Chain Fv Proteins by Site-Specific PEGylation", Protein Engineering, vol. 16, No. 10, pp. 761-770.
Yang, et al. (2005) "RONN: The Bio-Basis Function Neural Network Technique Applied to the Detection of Natively Disordered Regions in Proteins", Bioinformatics, vol. 21, No. 16, pp. 3369-3376.
Yankai, et al. (2006) "Ten Tandem Repeats of β-hCG 109-118 Enhance Immunogenicity and Anti-Tumor Effects of β-hCG C-Terminal Peptide Carried by Mycobacterial Heat-Shock Protein HSP65", Biochemical and Biophysical Research Communications, vol. 345, No. 4, pp. 1365-1371.
Yoon, et al., NF-KB and STAT3 Cooperatively Induce IL6 in Starved Cancer Cells, Oncogene, vol. 31, No. 29, pp. 3467-3481, 2011.
Yuan, et al. (1997) "Solution Structure of the Transforming Growth Factor Beta-Binding Protein-Like Module, a Domain Associated with Matrix Fibrils", the EMBO, Journal 16, No. 22, pp. 6659-6666.
Zapotocka, et al. "First experience of a hemophilia monitoring platform: florio HAEMO", Thromb Haemost. 2022, 6(e12685).
Zaveckas, et al. (Jun. 1, 2007) "Effect of Surface Histidine Mutations and their Number on the Partitioning and Refolding of Recombinant Human Granulocyte-Colony Stimulating Factor (Cys17ser) in Aqueous Two-Phase Systems Containing Chelated Metal Ions", Journal of Chromatography B, vol. 852, Issues 1-2, pp. 409-419.
Zhang, Design Of FRET-Based GFP Probes For Detection Of Protease Inhibitors, 2004, Oct. 15, pp. 674-678.
Zhang, et al. (Oct. 2009) "Factor VIII Inhibitors: Risk Factors and Methods for Prevention and Immune Modulation", Clinical Reviews in Allergy & Immunology, vol. 37, Issue 2, pp. 114-124.
Zhou, et al. (Jun. 2005) "Procoagulant Stimulus Processing by the Intrinsic Pathway of Blood Plasma Coagulation", Biomaterials, vol. 26, Issue 16, pp. 2965-2973.
Zhu, et al. (Sep. 1999) "Molecular Cloning and Sequencing of Two 'Short Chain' and Two 'Long Chain' K (+) Channel-Blocking Peptides from the Chinese Scorpion Buthus Martensii Karsch", FEBS Letters, vol. 457, No. 3, pp. 509-514.
Zmachinsky, "Modern approaches to treatment of hemophilia", Meditsinskie novosti (Medical news), 2013, 3: 28-30. https://cyberleninka.ru/article/n/covremennye-podhody-k-lecheniyu-gemofilii/viewer.
Zucker et al., The In Vitro Assocaitation of Antihemophilic Factor and von Willebrand Factor, Thromb Haemostas, 1983, 49(1): 37-41.
Bioverativ Therapeutics Inc., "A Phase 1, Open-Label, Single-Site, Safety, Tolerability, and Pharmacokinetics Study of Repeat Doses of BIVV001", Investigator and Sponsor's Agreement and Brochure, Protocol No. 242HA102, EudraCT No. 2018-001535-51, Final, Version 3.0, Oct. 25, 2018.
Bioverativ Therapeutics Inc., Patient Information and Informed Consent Form for Phase 1, Open-Label, Single-Site, Safety, Tolerability, and Pharmacokinetics Study of Repeat Doses of BIVV001, Protocol No. 242HA102, Nov. 15, 2018.
Moffit et al., "Nonclinical Safety Assessment of BIVV001, A Next-Generation Recombinant Factor VIII Fc-VWF-XTEN Fusion Protein", Mar. 7, 2018.
U.S. Appl. No. 17/479,705, filed Sep. 20, 2021, Publ'n No. 2022/0106383, Publ'n Date Apr. 7, 2022, Ekta Seth Chhabra, Thrombin Cleavable Linker with XTEN ans its Uses Thereof.
U.S. Appl. No. 18/358,601, filed Jul. 25, 2023, Publ'n No. 2024/0083875, Publ'n Date Mar. 14, 2024, Ekta Seth Chhabra, Thrombin Cleavable Linker with XTEN and its Uses Thereof.
U.S. Appl. No. 15/110,673, filed Jul. 8, 2016, Publ'n No. 2017/0073393, Publ'n Date Mar. 16, 2017, U.S. Pat. No. 11,192,936, Grant Date Dec. 7, 2021, Ekta Seth Chhabra, Factor VIII Chimeric Proteins and Uses Thereof.
U.S. Appl. No. 17/519,719, filed Nov. 5, 2021, Publ'n No. 2022/0275057, Publ'n Date Sep. 1, 2022, Ekta Seth Chhabra, Factor VIII Chimeric Proteins and Uses Thereof.
U.S. Appl. No. 17/217,752, filed Mar. 30, 2021, Publ'n No. 2022/0010347, Publ'n Date Jan. 13, 2022, Bettina Strack-Logue, Methods of Treating Hemophilic Arthropathy Using Chimeric Clotting Factors.
U.S. Appl. No. 16/415,893, filed May 17, 2019, Publ'n No. 2019/0375822, Publ'n Date Dec. 12, 2019, Ekta Seth Chhabra, Methods of Treating Hemophilia A.

(56) References Cited

OTHER PUBLICATIONS

U.S. Appl. No. 18/572,006, filed Jun. 23, 2022, Tyler Carlage, Formulations of Factor VIII Chimeric Proteins and Uses Thereof.
Bioverativ Therapeutics Inc., "A Phase 1, Open-Label, Single-Site, Safety, Tolerability, and Pharmacokinetics Study of Repeat Doses of BIVV001", Patient Information Sheet and Informed Consent Form, Protocol No. 242HA101, Final Form for Bulgaria, Version 2.0, Nov. 15, 2018.
Bioverativ, a Sanofi company, "A Phase 3 Open-label Interventional Study of Intravenous Recombinant Coagulation Factor VIII Fc-von Willebrand Factor-XTEN Fusion Protein, Efanesoctocog Alfa (BIVV001), in Patients With Severe Hemophilia A (XTEND-1)", Study Record, NCT04161495, May 24, 2023.
Bioverativ, a Sanofi company, "A Phase 3 Open-Label, Multicenter Study of the Safety, Efficacy, and Pharmacokinetics of Intravenous Recombinant Coagulation Factor VIII Fc-von Willebrand Factor-XTEN Fusion Protein (rFVIIIFc-VWF-XTEN; BIVV001) in Previously Treated Patients >12 Years of Age With Severe Hemophilia A", Amended Clinical Trial Protocol 05, Protocol No. EFC16293, Version No. 1, Aug. 20, 2021.
Bioverativ, a Sanofi company, "A Phase 3 Open-Label, Multicenter Study of the Safety, Efficacy, and Pharmacokinetics of Intravenous Recombinant Coagulation Factor VIII Fc-von Willebrand Factor-XTEN Fusion Protein (rFVIIIFc-VWF-XTEN; BIVV001) in Previously Treated Patients 12 Years of Age With Severe Hemophilia A", Statistical Analysis Plan, NCT04161495, Protocol No. EFC16293, EudraCT: 2019-002023-15, Version No. 8.0, Jun. 16, 2020.
Bioverativ, a Sanofi company, "A Safety, Tolerability, and Pharmacokinetics Study of a Single Intravenous Injection of Recombinant Coagulation Factor VIII Fc-Von Willebrand Factor-XTEN Fusion Protein (rFVIIIFc-VWF-XTEN) (BIVV001) in Previously Treated Adults With Severe Hemophilia A (Exten-A)", Study Record, Protocol No. 242HA101, Apr. 19, 2022.
Clinicaltrials.gov, NCT01027364, Study of Recombinant Factor IX Fc Fusion Protein (rFIXFc) in Subjects with Hemophilia B, Dec. 7, 2009.
Clinicaltrials.gov, NCT01181128, Study to Evaluate the Safety, Pharmacokinetics and Efficacy of Recombinant Factor VIII Fc Fusion Protein (rFVIIIFc) in Previously Treated Subjects With Severe Hemophilia A, Aug. 13, 2010.
Clinicaltrials.gov, NCT01425723, Long-Term Safety and Efficacy of Recombinant Human Coagulation Factor IX Fusion Protein (rFIXFc) in the Prevention and Treatment of Bleeding Episodes in Previously Treated Subjects with Hemophilia B, Aug. 30, 2011.
Clinicaltrials.gov, NCT01454739, Long-Term Safety and Efficacy of rFVIIIFc in the Prevention and Treatment of Bleeding Episodes in Previously Treated Participants With Hemophilia A (Aspire), Oct. 19, 2011.
Clinicaltrials.gov, NCT01458106, Study to Evaluate the Safety, Efficacy, and Pharmacokinetics of Recombinant Coagulation Factor VIII Fc Fusion Protein (rFVIIIFc) in Previously Treated Pediatric Subjects With Hemophilia A (Kids Along), Oct. 24, 2011.
Extended European Search Report received for European Patent Application No. 23179872.9 mailed on Sep. 28, 2023.
Feldman et al., "Tailored Prophylaxis in Severe Hemophilia A: Interim Results From the First 5 Years of the Canadian Hemophilia Primary Prophylaxis Study," J Thromb Haemost 4:1228-1236, 2006.
Fischer et al., "Prophylaxis in real life scenarios", Haemophilia 20(Suppl 4): 106- 113 (2014).
Guo et al., "Contrast Clinical Efficiency Evaluation of Children and Adult Patients with Severe Hemophilia A Prevention and Treatment of Low Dose", Heilongjiang Medical Journal, Aug. 2020, 44(8): 1043-1044.
Hilgartner, "Current treatment of hemophilic arthropathy", Current Opinion in Pediatrics, Feb. 2002, 14(1): 46-49.
International Search Report and Written Opinion received for PCT Application No. PCT/US2017/064302, mailed on Mar. 28, 2018 .

Kavakli et al., "Once-weekly prophylactic treatment vs. on-demand treatment with nonacog alfa in patients with moderately severe to severe haemophilia B", Haemophilia 22(3/4): 381-88 (2016).
Kerlin et al., "Long-Term Efficacy of rFVIIIFc Prophylaxis in Pediatric, Adolescent, and Adult Subjects with Target Joints and Severe Hemophilia A", Blood, vol. 126, No. 23, Dec. 2012; 57th Annual Meeting of the American-Society-of-Hematology; Orlando, FL, USA, Dec. 5-8, 2015 (Abstract).
Khayat, "Once-weekly prophylactic dosing of recombinant factor IX improves adherence in hemophilia B", J Blood Med., Nov. 30, 2016, 7: 275-282.
Korea Hemophilia Foundation, Posting dated Apr. 22, 2013 (No English translation available).
Krishnamoorthy et al., "Recombinant factor VIII Fc (rFVIIIFc) fusion protein reduces immunogenicity and induces tolerance in hemophilia A mice", Cellular Immunology, vol. 301, Dec. 29, 2015.
Liu et al., "NF-kB Signaling Regulates Functional Expression of the MHC Class I-Related Neonatal Fc Receptor for IgG via Intronic Binding Sequences," J Immunol 179(5):2999-3011, 2007.
Malec et al., "Immune Tolerance Induction Using Rfviiifc (Eloctate)", Blood, vol. 126, No. 23, Dec. 2015 (Abstract).
Nolan et al., "Long-term safety and efficacy of recombinant factor VIII Fc fusion protein (rFVIIIFc) in subjects with haemophilia A", Haemophilia, Jan. 2016, 22(1): 72-80.
Oymak et al., "The effectiveness of tools for monitoring hemophilic arthropathy", J Pediatr Hematol Oncol. 2015;37(2): e80-85.
Pasi et al., "Long-term safety and efficacy of extended-interval prophylaxis with recombinant factor IX Fc fusion protein (rFIXFc) in subjects with haemophilia B", Thromb Haemost., Feb. 28, 2017, 117(3): 508-518, ePublished Dec. 22, 2016.
Polyanskaya et al., "Modern Concepts of the Pathogenesis of Hemophilic Arthropathy", Issues of Hematology/Oncology and Immunopathology in Pediatrics, 2015, 14(3): 5-12, including English abstract.
Powell, J., et al., "Switching to recombinant factor IX Fc fusion protein prophylaxis results in fewer infusions, decreased factor IX consumption and lower bleeding rates," British Journal of Haematology 168: 113-123 (2015).
Powell, J.S., et al., "Long-Acting Recombinant Factor IX Fc Fusion Protein (rFIXFc) for Perioperative Management of Subjects with Haemophilia B in the Phase 3 B-Long Study," British Journal of Haematology, 168: 124-134 (2015).
Ragni, et al., "Use of Recombinant Factor IX in Subjects with Haemophilia B Undergoing Surgery", Haemophilia, vol. 8, No. 2, Blackwell Science, pp. 91-97. (Mar. 2002).
Rodriguez-Merchan, "Haemophilic synovitis: basic concepts", Haemophilia, 2007, 13(Suppl 3): 1-3.
Rodriguez-Merchan, et al., "General principals and indications of synoviorthesis (medical synovectomy) in haemophilia", Haemophilia, 2001, 7(Suppl 2): 6-10.
Simioni, et al. (Oct. 22, 2009) "X-Linked Thrombophilia with a Mutant Factor IX (Factor IX Padua)", The New England Journal of Medicine, vol. 361, No. 17, pp. 1671-1675.
Simpson et al., "Management of joint bleeding in hemophilia", Expert Rev Hematol., 2012, 5(4): 459-468.
Trakymiene et al., "Utility of the Haemophilia Joint Health Score in study of episodically treated boys with severe haemophilia A and B in Lithuania", Haemophilia 16(3) :479-486 (2010).
WV-TMF-68870: Model Patient Information Sheet and Informed Consent Form for Clinical Trial Identifier No. 9HB01EXT, dated Jul. 18, 2011, pp. 1-9.
WV-TMF-68872: Model Patient Information Sheet and Informed Consent Form for Clinical Trial Identifier No. 9HB01EXT, dated Jul. 18, 2011, pp. 1-8.
WV-TMF-68874: Model Patient Information Sheet and Informed Consent Form for Clinical Trial Identifier No. 9HB01EXT, dated Jul. 18, 2011, pp. 1-10.
WFH (World Federation of Hemophilia), "Hemophilia Joint Health Score (HJHS) 2.1," Feb. 7, 2011, available at https://elearning.wfh.org/resource/hemophilia-joint-health-score-hjhs/.

(56) References Cited

OTHER PUBLICATIONS

Wyrwich et al., "Changes in health-related quality of life with treatment of longer-acting clotting factors: results in the A-LONG and B-LONG clinical studies", Haemophilia, Nov. 2016, 22(6): 866-872.

Xiong et a., "Studies on Correlations Between Gene Mutations of Factor V, Factor VIII at Sites Cleavaged by Activated Protein C and Chinese Patients with Arterial Thrombotic Diseases", Chinese Journal of Microcirculation, 2004, 4: 49-51, 54.

* cited by examiner

METHODS OF TREATING HEMOPHILIA A

REFERENCE TO PRIORITY APPLICATIONS

This application claims the benefit of priority to U.S. Provisional Application No. 62/673,670, filed May 18, 2018, U.S. Provisional Application No. 62/712,880, filed Jul. 31, 2018, U.S. Provisional Application No. 62/773,785 filed Nov. 30, 2018, and U.S. Provisional Application No. 62/801,576, filed Feb. 5, 2019, each of which are incorporated herein by reference in their entireties.

REFERENCE TO SEQUENCE LISTING SUBMITTED ELECTRONICALLY

The content of the electronically submitted sequence listing in ASCII text file (Name: 612295_SA9-461_Sequence_Listing.K Size: 921 kilobytes; Date of Creation: May 17, 2019) is incorporated herein by reference in its entirety.

BACKGROUND OF THE DISCLOSURE

Hemophilia A is a bleeding disorder caused by defects in the gene encoding coagulation factor VIII (FVIII) and affects 1-2 in 10,000 male births. Graw et al., *Nat. Rev. Genet.* 6(6): 488-501 (2005). Patients affected with hemophilia A can be treated with infusions of purified or recombinantly produced FVIII. Many commercially available FVIII products are known to have a half-life of about 8-12 hours, requiring frequent intravenous administration to the patients. See Weiner M. A. and Cairo, M. S., Pediatric Hematology Secrets, Lee, M. T., 12. Disorders of Coagulation, Elsevier Health Sciences, 2001; Lillicrap, D. Thromb. Res. 122 Suppl 4:S2-8 (2008). In addition, a number of approaches have been tried in order to extend the FVIII half-life. For example, the approaches in development to extend the half-life of clotting factors include pegylation, glycopegylation, and conjugation with albumin. See Dumont et al., *Blood.* 119(13): 3024-3030 (2012). Consistent results have been demonstrated in humans, for example, rFVIIIFc was reported to improve half-life up to ~1.7-fold compared with ADVATE® in hemophilia A patients. See Powell et al., *Blood.* 119(13): 3031-3037 (2012). Therefore, the half-life increases, despite minor improvements, indicate the presence of other half-life limiting factors. See Liu, T. et al., 2007 ISTH meeting, abstract #P-M-035; Henrik, A. et al., 2011 ISTH meeting, abstract #P=MO-181; Liu, T. et al., 2011 ISTH meeting abstract #P-WE-131.

The current recommended standard of care involves the regular administration (routine prophylaxis) of FVIII to minimize the number of bleeding episodes. Routine prophylaxis has been associated with improvements in long-term outcomes, but is a demanding regimen limited by the need for frequent intravenous (IV) administration. See Manco-Johnson et al., *N Engl J Med.* 357(6):535-44 (2007). Extended half-life FVIII products have reduced the frequency of FVIII administration for prophylaxis; however, all interact with von Willebrand factor (VWF) and have comparable circulating half-lives, consistent with an upper limit on the half-life of rFVIII variants due to the half-life of endogenous VWF. See, e.g., Pipe et al., *Blood.* 128(16): 2007-16 (2016). Prophylactic dosing for these FVIII products is every 3 to 5 days.

Next-generation extended half-life FVIII products that prevent and control bleeding episodes for longer periods of time, resulting in less frequent administration, would potentially address the challenges of adherence to demanding prophylactic regimens, which in turn could improve the quality of life for hemophilia patients.

BRIEF SUMMARY OF THE DISCLOSURE

Certain aspects of the present disclosure are directed to a method of treating hemophilia A in a human subject in need thereof comprising administering to the subject multiple doses of a chimeric polypeptide comprising (i) a factor VIII (FVIII) protein and (ii) a von Willebrand factor (VWF) fragment comprising a D' domain of VWF and a D3 domain of VWF at a dosing interval, wherein at least one of the multiple doses is from about 15 IU/kg to about 100 IU/kg and the dosing interval is at least about every 7 days.

In some embodiments, the multiple doses comprise at least two doses, at least three doses, at least four doses, at least five doses, at least six doses, at least seven doses, at least eight doses, at least nine doses, at least ten doses, at least eleven doses, at least twelve doses, at least thirteen doses, at least fourteen doses, at least fifteen doses, at least sixteen doses, at least seventeen doses, at least eighteen doses, at least nineteen doses, at least twenty doses, or more.

In some embodiments, the treatment of hemophilia A comprises controlling or decreasing the incidence or frequency of a bleeding episode in a human subject in need thereof. In some embodiments, the treatment of hemophilia A comprises preventing or treating a bleeding episode in a human subject in need thereof.

In some embodiments, at least one of the multiple doses is from about 20 IU/kg to about 95 IU/kg, from about 20 IU/kg to about 90 IU/kg, from about 20 IU/kg to about 85 IU/kg, from about 20 IU/kg to about 80 IU/kg, from about 20 IU/kg to about 75 IU/kg, from about 20 IU/kg to about 70 IU/kg, from about 20 IU/kg to about 65 IU/kg, from about 20 IU/kg to about 60 IU/kg, from about 20 IU/kg to about 55 IU/kg, from about 20 IU/kg to about 50 IU/kg, from about 20 IU/kg to about 45 IU/kg, from about 20 IU/kg to about 40 IU/kg, from about 20 IU/kg to about 35 IU/kg, from about 20 IU/kg to about 30 IU/kg, or from about 20 IU/kg to about 25 IU/kg. In some embodiments, at least one of the multiple doses is from about 20 IU/kg to about 100 IU/kg, from about 25 IU/kg to about 100 IU/kg, from about 30 IU/kg to about 100 IU/kg, from about 35 IU/kg to about 100 IU/kg, from about 40 IU/kg to about 100 IU/kg, from about 45 IU/kg to about 100 IU/kg, from about 50 IU/kg to about 100 IU/kg, from about 55 IU/kg to about 100 IU/kg, from about 60 IU/kg to about 100 IU/kg, from about 65 IU/kg to about 100 IU/kg, from about 70 IU/kg to about 100 IU/kg, from about 75 IU/kg to about 100 IU/kg, from about 80 IU/kg to about 100 IU/kg, from about 85 IU/kg to about 100 IU/kg, or from about 90 IU/kg to about 100 IU/kg.

In some embodiments, at least one of the multiple doses is from about 20 IU/kg to about 80 IU/kg, from about 25 IU/kg to about 75 IU/kg, from about 30 IU/kg to about 70 IU/kg, from about 35 IU/kg to about 65 IU/kg, from about 40 IU/kg to about 60 IU/kg, or from about 45 IU/kg to about 55 IU/kg. In some embodiments, at least one of the multiple doses is from about 25 IU/kg to about 65 IU/kg.

In some embodiments, at least one of the multiple doses is about 20 IU/kg, about 25 IU/kg, about 30 IU/kg, about 35 IU/kg, about 40 IU/kg, about 45 IU/kg, about 50 IU/kg, about 55 IU/kg, about 60 IU/kg, about 65 IU/kg, about 70 IU/kg, about 75 IU/kg, about 80 IU/kg, about 85 IU/kg, about 90 IU/kg, about 95 IU/kg, or about 100 IU/kg. In some embodiments, at least one of the multiple doses is about 25 IU/kg. In some embodiments, at least one of the multiple doses is about 50 IU/kg. In some embodiments, at least one of the multiple doses is about 65 IU/kg. In some embodiments, at least one of the multiple doses is about 80 IU/kg.

In some embodiments, the dosing interval is at least about 5 days, at least about 6 days, at least about 7 days, at least about 8 days, at least about 9 days, at least about 10 days, at least about 11 days, at least about 12 days, at least about 13 days, at least about 14 days, at least about 15 days, at least about 16 days, at least about 17 days, at least about 18 days, at least about 19 days, at least about 20 days, at least about 21 days, at least about 22 days, at least about 23 days, at least about 24 days, at least about 25 days, at least about 26 days, at least about 27 days, at least about 28 days, at least about 29 days, at least about 30 days, or at least about 31 days.

In some embodiments, the dosing frequency is at least once every week, at least once every 2 weeks, at least once every 3 weeks, or at least once every 4 weeks. In some embodiments, the dosing interval is at least once every week. In some embodiments, the dosing interval is at least once every two weeks.

In some embodiments, the chimeric polypeptide is administered for prophylactic treatment.

In some embodiments, the FVIII protein is associated with the VWF fragment by a covalent bond. In some embodiments, the covalent bond is a peptide bond or a disulfide bond.

In some embodiments, the FVIII protein comprises a FVIII polypeptide and a first half-life extending moiety. In some embodiments, the first half-life extending moiety is fused to the C-terminus or the N-terminus of the FVIII polypeptide. In some embodiments, the first half-life extending moiety is inserted within the FVIII polypeptide. In some embodiments, the first half-life extending moiety is inserted within the B domain of the FVIII polypeptide. In some embodiments, the first half-life extending moiety is inserted within the FVIII polypeptide immediately downstream of an amino acid corresponding to amino acid residue 745 of SEQ ID NO: 65. In some embodiments, the first half-life extending moiety is fused to the FVIII polypeptide by a linker.

In some embodiments, the VWF fragment comprises a second half-life extending moiety. In some embodiments, the second half-life extending moiety is fused to the C-terminus or the N-terminus of the VWF fragment. In some embodiments, the second half-life extending moiety is inserted within the VWF fragment. In some embodiments, the second half-life extending moiety is fused to the C-terminus of the VWF fragment. In some embodiments, the second half-life extending moiety is fused to the VWF fragment by a linker.

In some embodiments, the first half-life extending moiety, the second half-life extending moiety, or both is selected from the group consisting of an albumin, an immunoglobulin Fc region, an XTEN sequence, the C-terminal peptide (CTP) of the β subunit of human chorionic gonadotropin, a PAS sequence, a HAP sequence, a transferrin, albumin-binding moieties, or any fragments, derivatives, variants, and any combination thereof.

In some embodiments, the first half-life extending moiety comprises a first XTEN.

In some embodiments, the first XTEN is inserted within the FVIII polypeptide immediately downstream of an amino acid corresponding to amino acid residue 745 of SEQ ID NO: 65.

In some embodiments, the second half-life extending moiety comprises a second XTEN. In some embodiments, the second XTEN is fused to the C-terminus of the VWF fragment.

In some embodiments, the FVIII protein comprises a first immunoglobulin (Ig) constant region or a portion thereof. In some embodiments, the first Ig constant region or the portion thereof is fused to the C-terminus or the N-terminus of the FVIII polypeptide. In some embodiments, the first Ig constant region or the portion thereof is inserted within the FVIII polypeptide. In some embodiments, the first Ig constant region or the portion thereof is fused to the C-terminus of the FVIII polypeptide. In some embodiments, the first Ig constant region or the portion thereof is fused to the FVIII polypeptide by a linker. In some embodiments, the first Ig constant region or the portion thereof comprises a first Fc domain or a portion thereof.

In some embodiments, the VWF fragment comprises a second Ig constant region or a portion thereof. In some embodiments, the second Ig constant region or the portion thereof is fused to the C-terminus or the N-terminus of the VWF fragment. In some embodiments, the second Ig constant region or the portion thereof is inserted within the VWF fragment. In some embodiments, the second Ig constant region or the portion thereof is fused to the C-terminus of the VWF fragment. In some embodiments, the second Ig constant region or the portion thereof is fused to the VWF fragment by a linker. In some embodiments, the linker is a cleavable linker. In some embodiments, the second Ig constant region or the portion thereof comprises a second Fc domain or a portion thereof.

In some embodiments, the FVIII protein and the VWF fragment are associated with each other through a covalent bond between the first Fc domain and the second Fc domain. In some embodiments, the FVIII protein and the VWF fragment are further associated with each other through a non-covalent interaction between the FVIII protein and the VWF fragment.

In one aspect, disclosed herein is a method of treating hemophilia A in a human subject comprising administering to the subject in need thereof multiple doses of a chimeric polypeptide at a dosing interval, wherein the chimeric polypeptide comprises: (i) a FVIII protein comprising a first FVIII polypeptide fragment comprising the amino acid sequence of SEQ ID NO: 215; a first XTEN sequence comprising the amino acid sequence of SEQ ID NO: 8 (AE288); a second FVIII polypeptide fragment comprising the amino acid sequence of SEQ ID NO: 216; and a first Fc region comprising the amino acid sequence of SEQ ID NO: 217; and (ii) a VWF protein comprising: a D' domain of VWF comprising the amino acid sequence of SEQ ID NO: 210; a D3 domain of VWF comprising the amino acid sequence of SEQ ID NO: 214; a second XTEN sequence comprising the amino acid sequence of SEQ ID NO: 58 (AE144_5A); an a2 linker comprising the amino acid sequence of SEQ ID NO: 88; and a second Fc region comprising the amino acid sequence of SEQ ID NO: 217, and wherein the first Fc region is covalently linked to the second Fc region by a disulfide bond.

In some embodiments, the chimeric polypeptide comprises a FVIII protein comprising a FVIII polypeptide, a first XTEN sequence, a first Fc region, and a VWF protein comprising a D' domain of VWF, a D3 domain of VWF, a second XTEN sequence, an a2 linker of FVIII and a second Fc region, wherein the FVIII polypeptide comprises the amino acid sequence of SEQ ID NO: 215, the first XTEN sequence comprises the amino acid sequence of AE288 (SEQ ID NO: 8) and is fused to the C-terminus of SEQ ID NO: 215, the FVIII polypeptide further comprises the amino acid sequence of SEQ ID NO: 216, the first Fc region comprises the amino acid sequence of SEQ ID NO: 217 and is fused to the C-terminus of SEQ ID NO: 216; the D' domain of VWF comprises the amino acid sequence of SEQ ID NO: 210; the D3 domain of VWF comprises the amino acid sequence of SEQ ID NO: 214, the second XTEN sequence comprises the amino acid sequence of AE144_5A (SEQ ID NO: 58) and is fused to the C-terminus of the D3 domain of VWF; the a2 linker comprises the amino acid sequence of SEQ ID NO: 88 and is fused to the C-terminus of the second XTEN sequence; the second Fc region comprises the amino acid sequence of SEQ ID NO: 217 and is fused to the C-terminus of the a2 linker; and wherein the first Fc region is covalently linked to the second Fc region by a disulfide bond.

In some embodiments, the chimeric polypeptide comprises a FVIII protein comprising a FVIII signal peptide comprising the amino acid sequence of SEQ ID NO: 64. In some embodiments, the chimeric polypeptide comprises a VWF protein comprising a VWF signal peptide comprising the amino acid sequence of SEQ ID NO: 208. In some embodiments, the chimeric polypeptide comprises a VWF protein comprising a D1D2 domain of VWF comprising the amino acid sequence of SEQ ID NO: 209.

In some embodiments, the chimeric polypeptide comprises a FVIII protein comprising an amino acid sequence at least about 80%, 90%, 95%, or 100% identical to SEQ ID NO: 201, SEQ ID NO: 203, or SEQ ID NO: 207; and a VWF protein comprising an amino acid sequence at least about 80%, 90%, 95%, or 100% identical to SEQ ID NO: 202 or SEQ ID NO: 205.

In one embodiment, the chimeric polypeptide comprises a FVIII protein comprising the amino acid sequence of SEQ ID NO: 203 and a VWF protein comprising the amino acid sequence of SEQ ID NO: 205. In another embodiment, the chimeric polypeptide comprises a FVIII protein comprising the amino acid sequence of SEQ ID NO: 201 and a VWF protein comprising the amino acid sequence of SEQ ID NO: 202. In another embodiment, the chimeric polypeptide comprises a FVIII protein comprising the amino acid sequence of SEQ ID NO: 207 and a VWF protein comprising the amino acid sequence of SEQ ID NO: 202.

In some embodiments, the chimeric polypeptide comprises a FVIII protein comprising an amino acid sequence at least about 80%, 90%, 95%, or 100% identical to a sequence selected from FVIII-161 (SEQ ID NO: 69), FVIII-169 (SEQ ID NO: 70), FVIII-170 (SEQ ID NO: 71), FVIII-173 (SEQ ID NO: 72); FVIII-195 (SEQ ID NO: 73); FVIII-196 (SEQ ID NO: 74), FVIII199 (SEQ ID NO: 75), FVIII-201 (SEQ ID NO: 76); FVIII-203 (SEQ ID NO: 77), FVIII-204 (SEQ ID NO: 78), FVIII-205 (SEQ ID NO: 79), FVIII-266 (SEQ ID NO: 80), FVIII-267 (SEQ ID NO: 81), FVIII-268 (SEQ ID NO: 82), FVIII-269 (SEQ ID NO: 83), FVIII-271 (SEQ ID NO: 84), FVIII-272 (SEQ ID NO: 85), FVIII-312 (SEQ ID NO: 173), or FVIII-312A (SEQ ID NO: 203); and a VWF protein comprising an amino acid sequence at least about 80%, 90%, 95%, or 100% identical to a sequence selected from VWF031 (SEQ ID NO: 86), VWF034 (SEQ ID NO: 87), VWF059 (SEQ ID NO: 197), VWF059A (SEQ ID NO: 202), or VWF036.

In some embodiments, the chimeric polypeptide is administered by a route selected from the group consisting of intravenous injection, intravenous infusion, subcutaneous administration, intramuscular administration, oral administration, nasal administration, and pulmonary administration.

In some embodiments, the chimeric polypeptide after the administration results in a FVIII plasma activity level of at least about 1%, at least about 2%, at least about 3%, at least about 4%, at least about 5%, at least about 6%, at least about 7%, at least about 8%, at least about 9%, or at least about 10%. In some embodiments, the FVIII plasma activity level is at least about 3%. In some embodiments, the FVIII plasma activity level is at least about 5%.

In some embodiments, the chimeric polypeptide after the administration results in a FVIII plasma activity level of at least about 1 IU/dL, at least about 2 IU/dL, at least about 3 IU/dL, at least about 4 IU/dL, at least about 5 IU/dL, at least about 6 IU/dL, at least about 7 IU/dL, at least about 8 IU/dL, at least about 9 IU/dL, or at least about 10 IU/dL. In some embodiments, the FVIII plasma activity level is at least about 3 IU/dL. In some embodiments, the FVIII plasma activity level is at least about 5 IU/dL.

In some embodiments, the FVIII plasma activity level is at least about 10 IU/dL at least about 5 days after the administration of the chimeric polypeptide. In some embodiments, the FVIII plasma activity level is at least about 5 IU/dL at least about 7 days after the administration of the chimeric polypeptide. In some embodiments, the FVIII plasma activity level is at least about 3 IU/dL at least about 8 days after the administration of the chimeric polypeptide. In some embodiments, the FVIII plasma activity level is at least about 1 IU/dL at least about 10 days after the administration of the chimeric polypeptide.

In some embodiments, at least one of the multiple doses is from about 50 IU/kg to about 80 IU/kg. In some embodiments, at least one of the multiple doses is from about 50 IU/kg to about 65 IU/kg. In some embodiments, at least one of the multiple doses is from about 65 IU/kg to about 80 IU/kg. In some embodiments, at least one of the multiple doses is from about 50 IU/kg to about 80 IU/kg, and the dosing interval is at least about 7 days. In some embodiments, at least one of the multiple doses is from about 50 IU/kg to about 65 IU/kg, and the dosing interval is at least about 5 days. In some embodiments, at least one of the multiple doses is from about 65 IU/kg to about 80 IU/kg, and the dosing interval is at least about 5 days.

In some embodiments, at least one of the multiple doses is about 50 IU/kg. In some embodiments, the multiple doses are about 50 IU/kg, and the dosing interval is about 5 days. In some embodiments, the multiple doses are about 50 IU/kg, and the dosing interval is about 7 days. In some embodiments, the multiple doses are about 50 IU/kg, and the dosing interval is about 14 days.

In some embodiments, at least one of the multiple doses is from about 50 IU/kg to about 80 IU/kg. In some embodiments, at least one of the multiple doses is from about 50 IU/kg to about 65 IU/kg. In some embodiments, at least one of the multiple doses is from about 65 IU/kg to about 80 IU/kg. In some embodiments, at least one of the multiple doses is from about 50 IU/kg to about 80 IU/kg, and the dosing interval is at least about 7 days. In some embodiments, at least one of the multiple doses is from about 50 IU/kg to about 65 IU/kg, and the dosing interval is at least about 7 days. In some embodiments, at least one of the multiple doses is from about 65 IU/kg to about 80 IU/kg, and the dosing interval is at least about 7 days.

In some embodiments, at least one of the multiple doses is from about 50 IU/kg to about 80 IU/kg, and the dosing interval is at least about 10 days. In some embodiments, at least one of the multiple doses is from about 50 IU/kg to about 65 IU/kg, and the dosing interval is at least about 10 days. In some embodiments, at least one of the multiple doses is from about 65 IU/kg to about 80 IU/kg, and the dosing interval is at least about 10 days.

In some embodiments, at least one of the multiple doses is from about 50 IU/kg to about 80 IU/kg, and the dosing interval is at least about 14 days. In some embodiments, at least one of the multiple doses is from about 50 IU/kg to about 65 IU/kg, and the dosing interval is at least about 14 days. In some embodiments, at least one of the multiple doses is from about 65 IU/kg to about 80 IU/kg, and the dosing interval is at least about 14 days.

In some embodiments, at least one of the multiple doses is from about 50 IU/kg to about 80 IU/kg, and the dosing interval is at least about 1 week. In some embodiments, at least one of the multiple doses is from about 50 IU/kg to about 65 IU/kg, and the dosing interval is at least about 1 week. In some embodiments, at least one of the multiple doses is from about 65 IU/kg to about 80 IU/kg, and the dosing interval is at least about 1 week.

In some embodiments, at least one of the multiple doses is from about 50 IU/kg to about 80 IU/kg, and the dosing interval is at least about 2 weeks. In some embodiments, at least one of the multiple doses is from about 50 IU/kg to about 65 IU/kg, and the dosing interval is at least about 2 weeks. In some embodiments, at least one of the multiple doses is from about 65 IU/kg to about 80 IU/kg, and the dosing interval is at least about 2 weeks.

In some embodiments, the dosing interval is at least about 5 days. In some embodiments, the dosing interval is at least about 7 days. In some embodiments, the dosing interval is about 5 days to about 14 days. In some embodiments, the dosing interval is about 7 days to about 14 days. In some embodiments, the dosing interval is at least about 10 days. In some embodiments, the dosing interval is about 10 days to about 21 days. In some embodiments, the dosing interval is about 14 days to about 21 days. In some embodiments, the dosing interval is about 14 days.

In some embodiments, the human subject is a female. In some embodiments, the human subject is a child. In some embodiments, the human subject is a child less than or equal to about 12 years old, less than about 11 years old, less than about 10 years old, less than about 9 years old, less than about 8 years old, less than about 7 years old, less than about 6 years old, less than about 5 years old, less than about 4 years old, less than about 3 years old, less than about 2 years old, or less than about 1 year old.

In some embodiments, the administration induces immune tolerance to FVIII in the human subject. In some embodiments, the administration reduces an inhibitory immune response to FVIII in the human subject. In some embodiments, the inhibitory immune response to FVIII comprises a high titer of anti-FVIII antibodies in the human subject.

In some embodiments, administration of the chimeric polypeptide induces no FVIII inhibitor after about 7 days, about 10 days, about 11 days, about 12 days, about 13 days, about 14 days, about 15 days, about 20 days, about 24 days, about 25 days, about 28 days, about 30 days, or about 35 days of the administration. In some embodiments, administration of the chimeric polypeptide induces no FVIII inhibitor after about 28 days of the administration.

BRIEF DESCRIPTION OF THE DRAWINGS/FIGURES

FIG. 1 is a schematic representation of rFVIIIFc-VWF-XTEN. FVIII: factor VIII; VWF: von Willebrand Factor; A1, A2, A3, C1, C2: domains of FVIII; D'D3: domains of VWF; Fc: Fc region of immunoglobulin constant region.

Figure 2A:
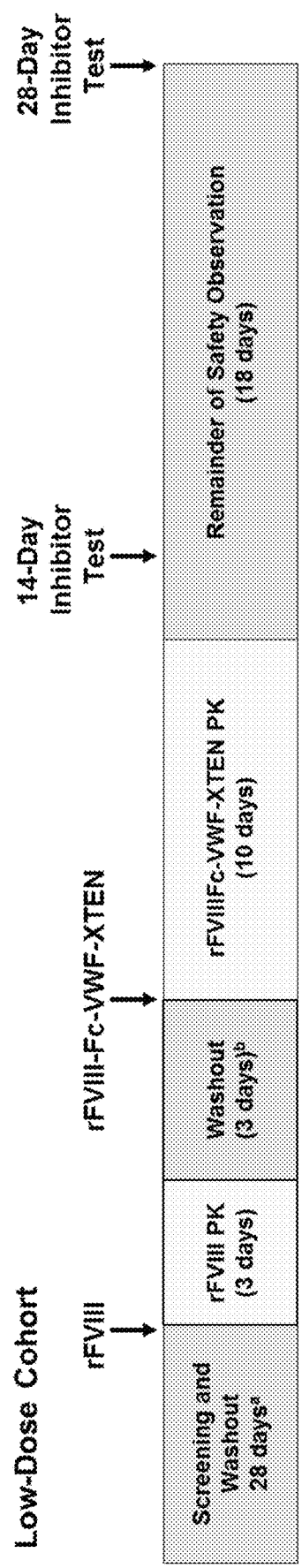
Figure 2B:
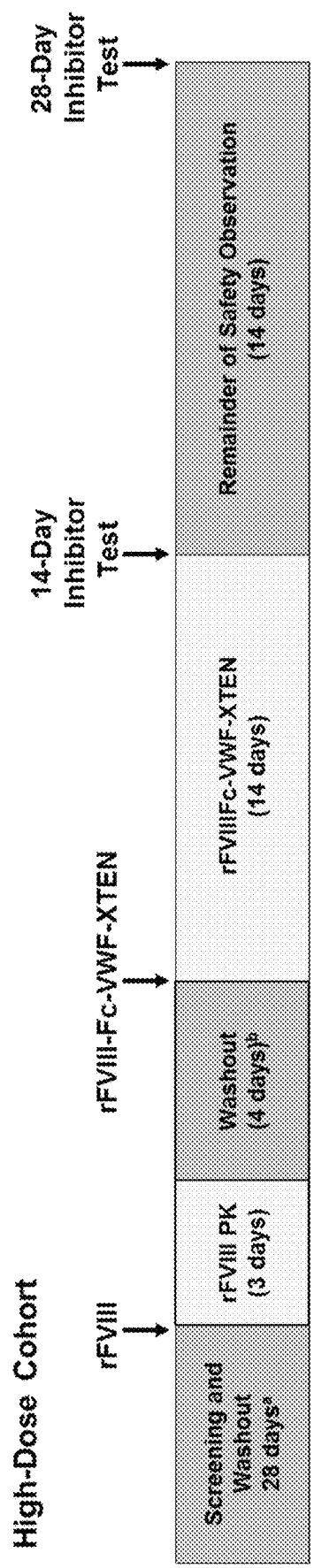

FIGS. 2A and 2B show the protocol for testing the safety and efficacy of rFVIIIFc-VWF-XTEN in human patients in a low-dose cohort administered 25 IU/kg rFVIIIFc-VWF-XTEN (FIG. 2A) and a high-dose cohort administered 65 IU/kg rFVIIIFc-VWF-XTEN (FIG. 2B).

Figure 3A:
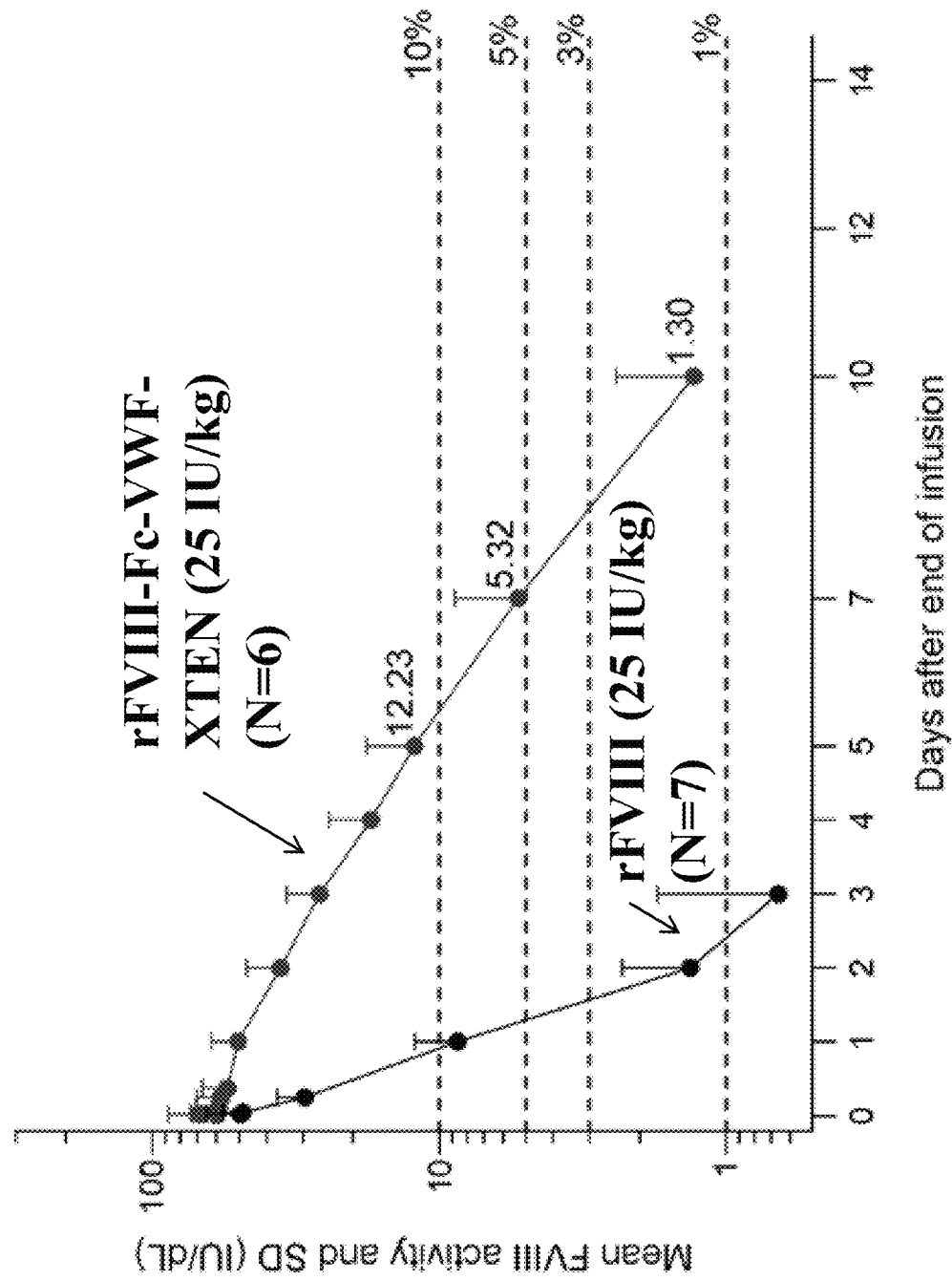
Figure 3B:
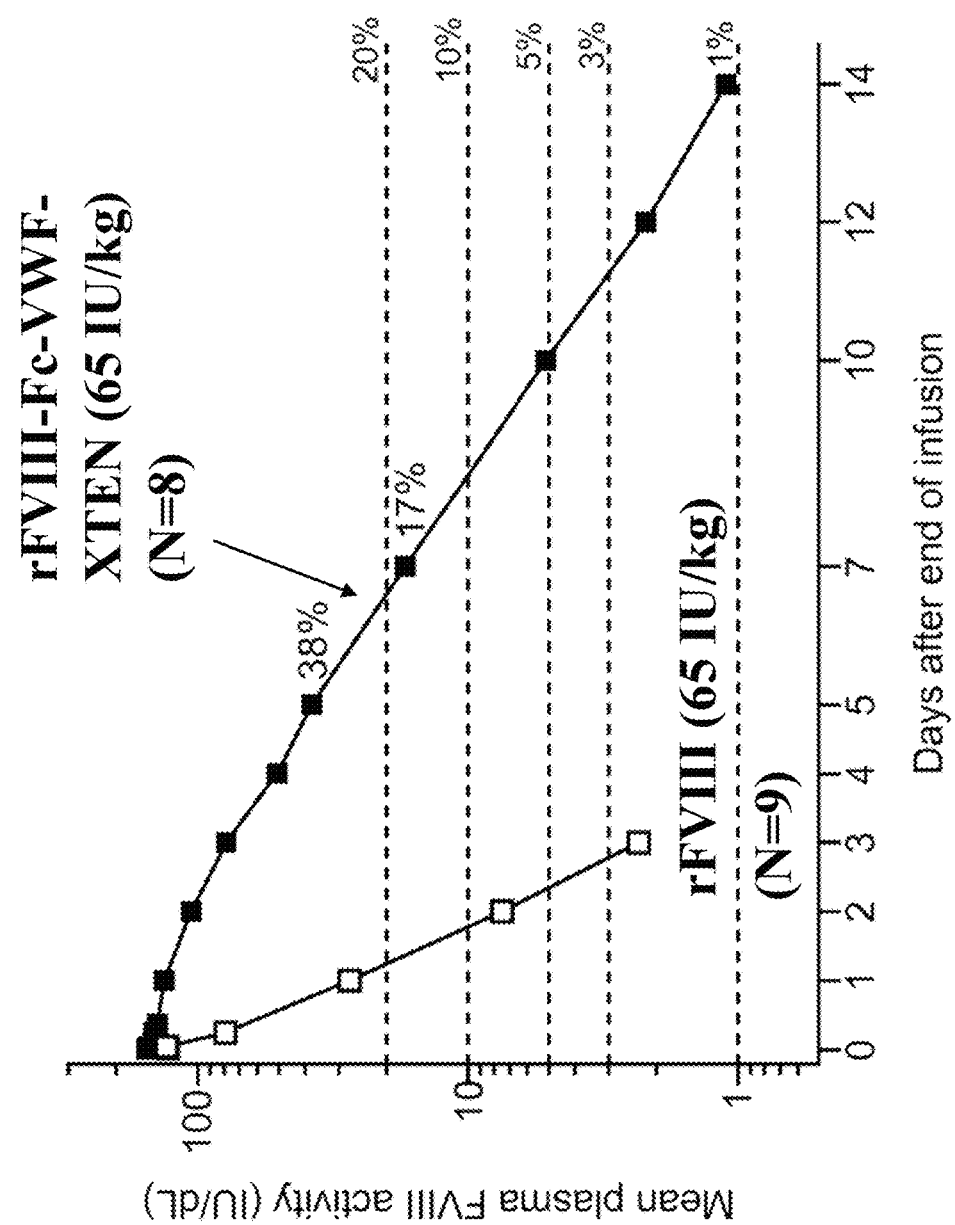

FIGS. 3A-3B are graphical representations of the baseline-corrected FVIII activity levels based on an activated partial thromboplastin time (aPTT) test in human subjects with severe hemophilia A administered 25 IU/kg rFVIII followed by a washout period and then 25 IU/kg rFVIIIFc-VWF-XTEN (FIG. 3A; low dose cohort) or 65 IU/kg rFVIII followed by a washout period and then 65 IU/kg rFVIIIFc-VWF-XTEN (FIG. 3B; high dose cohort). Horizontal dashed lines indicate 3%, 5%, 10%, and 20% FVIII activity.

Figure 4:
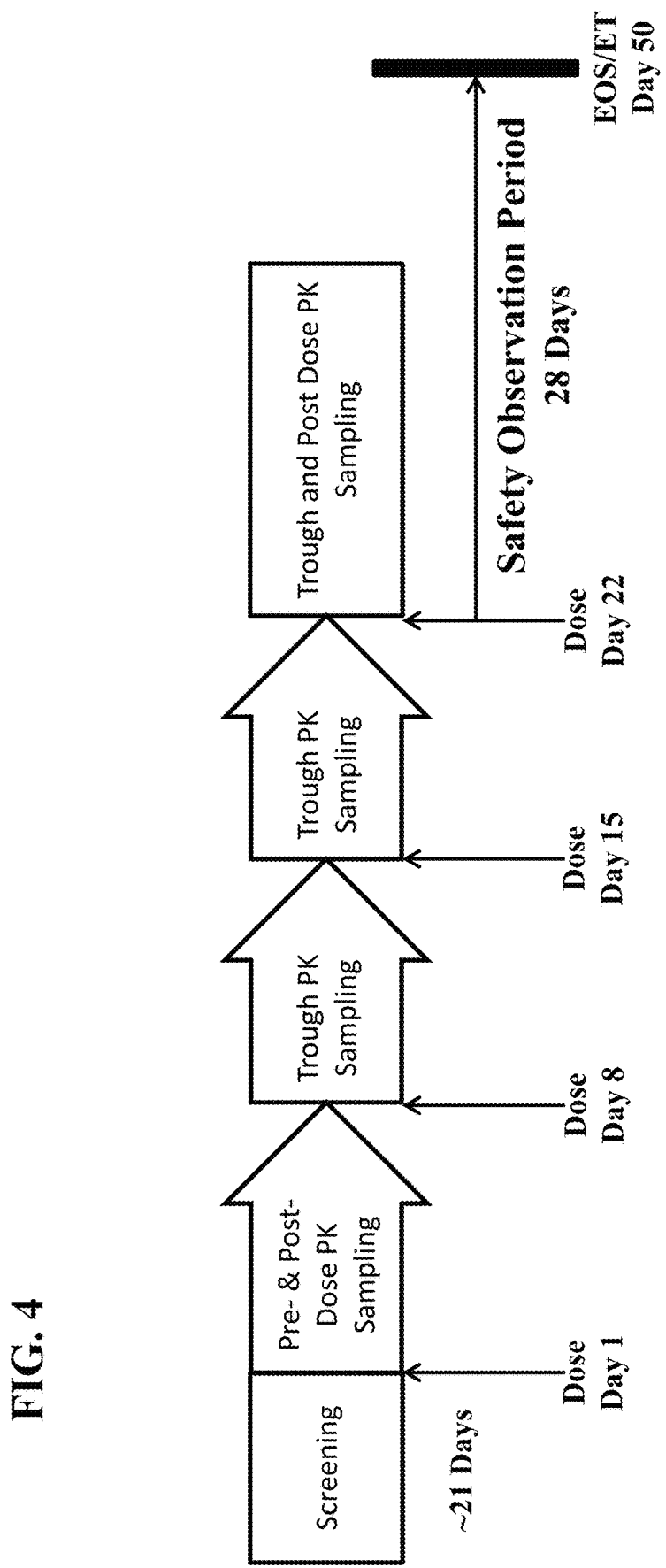

FIG. 4 is a schematic representation of the design of a clinical study to assess the safety and tolerability of a total of four once-weekly doses of rFVIIIFc-VWF-XTEN at a dose of 50 IU/kg or 65 IU/kg in adult male, previously treated patients (PTPs), 18 to 65 years of age (inclusive), with severe hemophilia A. EOS=End of Study; ET=Early Termination; PK=Pharmacokinetics.

DETAILED DESCRIPTION OF THE DISCLOSURE

The present disclosure is directed to a method of treating a bleeding disease or condition, e.g., hemophilia A, in a human subject in need thereof comprising administering to the subject multiple doses of a chimeric polypeptide comprising (i) a factor VIII (FVIII) polypeptide and (ii) a von Willebrand factor (VWF) fragment comprising a D' domain of VWF and a D3 domain of VWF at a dosing interval. In some embodiments, at least one of the multiple doses is from about 15 IU/kg to about 100 IU/kg. In some embodiments, the dosing interval is at least about every 5 days. In some embodiments, the dosing interval is at least about every 7 days.

I. Definitions

It is to be noted that the term "a" or "an" entity refers to one or more of that entity; for example, "a nucleotide sequence," is understood to represent one or more nucleotide sequences. As such, the terms "a" (or "an"), "one or more," and "at least one" can be used interchangeably herein.

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

It is understood that wherever aspects are described herein with the language "comprising," otherwise analogous aspects described in terms of "consisting of" and/or "consisting essentially of" are also provided.

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Units, prefixes, and symbols are denoted in their Systeme International de Unites (SI) accepted form. Numeric ranges are inclusive of the numbers defining the range. Unless otherwise indicated, amino acid sequences are written left to right in amino to carboxy orientation. The headings provided herein are not limitations of the various aspects of the disclosure. Accordingly, the terms defined immediately below are more fully defined by reference to the specification in its entirety.

The term "about" is used herein to mean approximately, roughly, around, or in the regions of. When the term "about" is used in conjunction with a numerical range, it modifies that range by extending the boundaries above and below the numerical values set forth. In general, the term "about" can modify a numerical value above and below the stated value by a variance of, e.g., 10 percent, up or down (higher or lower).

The term "polynucleotide" or "nucleotide" is intended to encompass a singular nucleic acid as well as plural nucleic acids, and refers to an isolated nucleic acid molecule or construct, e.g., messenger RNA (mRNA) or plasmid DNA (pDNA). In certain embodiments, a polynucleotide comprises a conventional phosphodiester bond or a non-conventional bond (e.g., an amide bond, such as found in peptide nucleic acids (PNA)). The term "nucleic acid" refers to any one or more nucleic acid segments, e.g., DNA or RNA fragments, present in a polynucleotide. By "isolated" nucleic acid or polynucleotide is intended a nucleic acid molecule, DNA or RNA, which has been removed from its native environment. For example, a recombinant polynucleotide encoding a Factor VIII polypeptide contained in a vector is considered isolated for the purposes of the present disclosure. Further examples of an isolated polynucleotide include recombinant polynucleotides maintained in heterologous host cells or purified (partially or substantially) from other polynucleotides in a solution. Isolated RNA molecules include in vivo or in vitro RNA transcripts of polynucleotides of the present disclosure. Isolated polynucleotides or nucleic acids according to the present disclosure further include such molecules produced synthetically. In addition, a polynucleotide or a nucleic acid can include regulatory elements such as promoters, enhancers, ribosome binding sites, or transcription termination signals.

Certain proteins secreted by mammalian cells are associated with a secretory signal peptide which is cleaved from the mature protein once export of the growing protein chain across the rough endoplasmic reticulum has been initiated. Those of ordinary skill in the art are aware that signal peptides are generally fused to the N-terminus of the polypeptide, and are cleaved from the complete or "full-length" polypeptide to produce a secreted or "mature" form of the polypeptide. In certain embodiments, a native signal peptide or a functional derivative of that sequence that retains the ability to direct the secretion of the polypeptide that is operably associated with it. Alternatively, a heterologous mammalian signal peptide, e.g., a human tissue plasminogen activator (TPA) or mouse β-glucuronidase signal peptide, or a functional derivative thereof, can be used.

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" can be used instead of, or interchangeably with any of these terms. The term "polypeptide" is also intended to refer to the products of post-expression modifications of the polypeptide, including without limitation glycosylation, acetylation, phosphorylation, amidation, derivatization by known protecting/blocking groups, proteolytic cleavage, or modification by non-naturally occurring amino acids. A polypeptide can be derived from a natural biological source or produced recombinant technology, but is not necessarily translated from a designated nucleic acid sequence. It can be generated in any manner, including by chemical synthesis.

An "isolated" polypeptide or a fragment, variant, or derivative thereof refers to a polypeptide that is not in its natural milieu. No particular level of purification is required. For example, an isolated polypeptide can simply be removed from its native or natural environment. Recombinantly produced polypeptides and proteins expressed in host cells are considered isolated for the purpose of the disclosure, as are native or recombinant polypeptides which have been separated, fractionated, or partially or substantially purified by any suitable technique.

Also included in the present disclosure are fragments or variants of polypeptides, and any combination thereof. The term "fragment" or "variant" when referring to polypeptide binding domains or binding molecules of the present disclosure include any polypeptides which retain at least some of the properties (e.g., FcRn binding affinity for an FcRn binding domain or Fc variant, coagulation activity for an FVIII variant, or FVIII binding activity for the VWF fragment) of the reference polypeptide. Fragments of polypeptides include proteolytic fragments, as well as deletion fragments, in addition to specific antibody fragments discussed elsewhere herein, but do not include the naturally occurring full-length polypeptide (or mature polypeptide). Variants of polypeptide binding domains or binding molecules of the present disclosure include fragments as described above, and also polypeptides with altered amino acid sequences due to amino acid substitutions, deletions, or insertions. Variants can be naturally or non-naturally occurring. Non-naturally occurring variants can be produced using art-known mutagenesis techniques. Variant polypeptides can comprise conservative or non-conservative amino acid substitutions, deletions or additions.

The term "VWF protein" or "VWF proteins" used herein means any VWF fragments that interact with FVIII and retain at least one or more properties that are normally provided to FVIII by full-length VWF, e.g., preventing premature activation to FVIIIa, preventing premature proteolysis, preventing association with phospholipid membranes that could lead to premature clearance, preventing binding to FVIII clearance receptors that can bind naked FVIII but not VWF-bound FVIII, and/or stabilizing the FVIII heavy chain and light chain interactions. A VWF fragment referred to herein is a VWF polypeptide that is less than the full-length VWF protein, wherein the VWF fragment retains the ability to interact with and/or bind to FVIII.

A "conservative amino acid substitution" is one in which the amino acid residue is replaced with an amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, if an amino acid in a polypeptide is replaced with another amino acid from the same side chain family, the substitution is considered to be conservative. In other embodiments, a string of amino acids can be conservatively replaced with a structurally similar string that differs in order and/or composition of side chain family members.

As known in the art, "sequence identity" between two polypeptides is determined by comparing the amino acid sequence of one polypeptide to the sequence of a second polypeptide. When discussed herein, whether any particular polypeptide is at least about 50%, 60%, 70%, 75%, 80%, 85%, 90%, 95%, 99%, or 100% identical to another polypeptide can be determined using methods and computer programs/software known in the art such as, but not limited to, the BESTFIT program (Wisconsin Sequence Analysis Package, Version 8 for Unix, Genetics Computer Group, University Research Park, 575 Science Drive, Madison, WI 53711). BESTFIT uses the local homology algorithm of Smith and Waterman, Advances in Applied Mathematics 2:482-489 (1981), to find the best segment of homology between two sequences. When using BESTFIT or any other sequence alignment program to determine whether a particular sequence is, for example, 95% identical to a reference sequence according to the present disclosure, the parameters are set, of course, such that the percentage of identity is calculated over the full-length of the reference polypeptide sequence and that gaps in homology of up to 5% of the total number of amino acids in the reference sequence are allowed.

As used herein, an "amino acid corresponding to" or an "equivalent amino acid" in a VWF sequence or a FVIII protein sequence is identified by alignment to maximize the identity or similarity between a first VWF or FVIII sequence and a second VWF or FVIII sequence. The number used to identify an equivalent amino acid in a second VWF or FVIII sequence is based on the number used to identify the corresponding amino acid in the first VWF or FVIII sequence.

As used herein, the term "insertion site" refers to a position in a FVIII polypeptide, or fragment, variant, or derivative thereof, which is immediately downstream of the position at which a half-life extending moiety or heterologous moiety can be inserted. An "insertion site" is specified as a number, the number being the number of the amino acid in mature native FVIII (SEQ ID NO: 65) to which the insertion site corresponds, which is immediately C-terminal to the position of the insertion. For example, the phrase "a3 comprises an XTEN at an insertion site which corresponds to amino acid 1656 of SEQ ID NO: 65" indicates that the heterologous moiety is located between two amino acids corresponding to amino acid 1656 and amino acid 1657 of SEQ ID NO: 65.

The phrase "immediately downstream of an amino acid" as used herein refers to position right next to the terminal carboxyl group of the amino acid. For example, an insertion site immediately downstream of amino acid 745 corresponding to the mature wild type FVIII protein means that the insertion site is between amino acid 745 and amino acid 746 corresponding to the mature wild type FVIII protein. Similarly, the phrase "immediately upstream of an amino acid" refers to the position right next to the terminal amine group of the amino acid.

The phrase "between two amino acids of an insertion site" as used herein refers to a position in which an XTEN or any other polypeptide is inserted between two adjacent amino acids. Thus, the phrases "inserted immediately downstream of an amino acid" and "inserted between two amino acids of an insertion site" are used synonymously with "inserted at an insertion site."

The terms "inserted," "is inserted," "inserted into" or grammatically related terms, as used herein refers to the position of an XTEN in a chimeric polypeptide relative to the analogous position in native mature human FVIII. As used herein the terms refer to the characteristics of the recombinant FVIII polypeptide relative to native mature human FVIII, and do not indicate, imply or infer any methods or process by which the chimeric polypeptide was made. For example, in reference to a chimeric polypeptide provided herein, the phrase "an XTEN is inserted into immediately downstream of residue 745 of the FVIII polypeptide" means that the chimeric polypeptide comprises an XTEN immediately downstream of an amino acid which corresponds to amino acid 745 in native mature human FVIII, e.g., bounded by amino acids corresponding to amino acids 745 and 746 of native mature human FVIII.

A "fusion" or "chimeric" protein comprises a first amino acid sequence linked to a second amino acid sequence with which it is not naturally linked in nature. The amino acid sequences which normally exist in separate proteins can be brought together in the fusion polypeptide, or the amino acid sequences which normally exist in the same protein can be placed in a new arrangement in the fusion polypeptide, e.g., fusion of a Factor VIII domain of the disclosure with an Ig Fc domain. A fusion protein is created, for example, by chemical synthesis, or by creating and translating a polynucleotide in which the peptide regions are encoded in the desired relationship. A chimeric polypeptide can further comprise a second amino acid sequence associated with the first amino acid sequence by a covalent, non-peptide bond or a non-covalent bond.

The term "linked" as used herein refers to a first amino acid sequence or nucleotide sequence covalently or non-covalently joined to a second amino acid sequence or nucleotide sequence, respectively. The first amino acid or nucleotide sequence can be directly joined or juxtaposed to the second amino acid or nucleotide sequence or alternatively an intervening sequence can covalently join the first sequence to the second sequence. The term "linked" means not only a fusion of a first amino acid sequence to a second amino acid sequence at the C-terminus or the N-terminus, but also includes insertion of the whole first amino acid sequence (or the second amino acid sequence) into any two amino acids in the second amino acid sequence (or the first amino acid sequence, respectively). In some embodiments, the first amino acid sequence can be linked to a second amino acid sequence by a peptide bond or a linker. The first nucleotide sequence can be linked to a second nucleotide sequence by a phosphodiester bond or a linker. The linker can be a peptide or a polypeptide (for polypeptide chains) or a nucleotide or a nucleotide chain (for nucleotide chains) or any chemical moiety (for both polypeptide and polynucleotide chains). The term "linked" is also indicated by a hyphen (-).

As used herein the term "associated with" refers to a covalent or non-covalent bond formed between a first amino acid chain and a second amino acid chain. In some embodiments, the term "associated with" means a covalent, non-peptide bond or a non-covalent bond. This association can be indicated by a colon, i.e., (:). In other embodiments, it means a covalent bond except a peptide bond. For example, the amino acid cysteine comprises a thiol group that can form a disulfide bond or bridge with a thiol group on a second cysteine residue. In most naturally occurring IgG molecules, the CH1 and CL regions are associated by a disulfide bond and the two heavy chains are associated by two disulfide bonds at positions corresponding to 239 and 242 using the Kabat numbering system (position 226 or 229, EU numbering system). Examples of covalent bonds include, but are not limited to, a peptide bond, a metal bond, a hydrogen bond, a disulfide bond, a sigma bond, a pi bond, a delta bond, a glycosidic bond, an agnostic bond, a bent bond, a dipolar bond, a Pi backbond, a double bond, a triple bond, a quadruple bond, a quintuple bond, a sextuple bond, conjugation, hyperconjugation, aromaticity, hapticity, or antibonding. Non-limiting examples of non-covalent bond include an ionic bond (e.g., cation-pi bond or salt bond), a metal bond, a hydrogen bond (e.g., dihydrogen bond, dihydrogen complex, low-barrier hydrogen bond, or symmetric hydrogen bond), van der Walls force, London dispersion force, a mechanical bond, a halogen bond, aurophilicity, intercalation, stacking, entropic force, or chemical polarity.

As used herein, the term "cleavage site" or "enzymatic cleavage site" refers to a site recognized by an enzyme. Certain enzymatic cleavage sites comprise an intracellular processing site. In some embodiments, a polypeptide has an enzymatic cleavage site cleaved by an enzyme that is activated during the clotting cascade, such that cleavage of such sites occurs at the site of clot formation. Exemplary such sites include, e.g., those recognized by thrombin, Factor XIa or Factor Xa. Exemplary FXIa cleavage sites include, e.g., TQSFNDFTR (SEQ ID NO: 1) and SVSQTSKLTR (SEQ ID NO: 3). Exemplary thrombin cleavage sites include, e.g., DFLAEGGGVR (SEQ ID NO: 4), TTKIKPR (SEQ ID NO: 5), LVPRG (SEQ ID NO: 6), ALRPR (SEQ ID NO: 7), ISDKNTGDYYEDSYEDISAY-LLSKNNAIEPRSFS (SEQ ID NO: 106), DKNTGDYYED-SYEDISAYLLSKNNAIEPRSFS (SEQ ID NO: 88), and IEPRSFS (SEQ ID NO: 194). Other enzymatic cleavage sites are known in the art and described in elsewhere herein.

As used herein, the term "processing site" or "intracellular processing site" refers to a type of enzymatic cleavage site in a polypeptide which is a target for enzymes that function after translation of the polypeptide. In some embodiments, such enzymes function during transport from the Golgi lumen to the trans-Golgi compartment. Intracellular processing enzymes cleave polypeptides prior to secretion of the protein from the cell. Examples of such processing sites include, e.g., those targeted by the PACE/furin (where PACE is an acronym for Paired basic Amino acid Cleaving Enzyme) family of endopeptidases. These enzymes are localized to the Golgi membrane and cleave proteins on the carboxyterminal side of the sequence motif Arg-[any residue]-(Lys or Arg)-Arg. As used herein the "furin" family of enzymes includes, e.g., PCSK1 (also known as PC1/PC3), PCSK2 (also known as PC2), PCSK3 (also known as furin or PACE), PCSK4 (also known as PC4), PCSK5 (also known as PC5 or PC6), PCSK6 (also known as PACE4), or PCSK7 (also known as PC7/LPC, PC8, or SPC7). Other processing sites are known in the art.

In constructs that include more than one processing or cleavage site, it will be understood that such sites can be the same or different.

A "processable linker" as used herein refers to a linker comprising at least one intracellular processing site, which are described elsewhere herein.

As used herein, the term "half-life" refers to a biological half-life of a particular polypeptide in vivo. Half-life can be represented by the time required for half the quantity administered to a subject to be cleared from the circulation and/or other tissues in the animal. When a clearance curve of a given polypeptide is constructed as a function of time, the curve is usually biphasic with a rapid α-phase and longer β-phase. The α-phase typically represents an equilibration of the administered Fc polypeptide between the intra- and extra-vascular space and is, in part, determined by the size of the polypeptide. The β-phase typically represents the catabolism of the polypeptide in the intravascular space. In some embodiments, FVIII and chimeric polypeptides comprising FVIII are monophasic, and thus do not have an alpha phase, but just the single beta phase. Therefore, in certain embodiments, the term half-life as used herein refers to the half-life of the polypeptide in the β-phase. The typical beta phase half-life of a human antibody in humans is 21 days. In certain embodiments, the half-life is expressed as the half-life of the terminal phase.

Hemostatic disorder, as used herein, means a genetically inherited or acquired condition characterized by a tendency to hemorrhage, either spontaneously or as a result of trauma, due to an impaired ability or inability to form a fibrin clot. Examples of such disorders include the hemophilias. The three main forms are hemophilia A (factor VIII deficiency), hemophilia B (factor IX deficiency or "Christmas disease") and hemophilia C (factor XI deficiency, mild bleeding tendency). Other hemostatic disorders include, e.g., Von Willebrand disease, Factor XI deficiency (PTA deficiency), Factor XII deficiency, deficiencies or structural abnormalities in fibrinogen, prothrombin, Factor V, Factor VII, Factor X or factor XIII, Bernard-Soulier syndrome, which is a defect or deficiency in GPIb. GPIb, the receptor for VWF, can be defective and lead to lack of primary clot formation (primary hemostasis) and increased bleeding tendency), and thrombasthenia of Glanzman and Naegeli (Glanzmann thrombasthenia). In liver failure (acute and chronic forms), there is insufficient production of coagulation factors by the liver; this can increase bleeding risk.

"Administer" or "administering," as used herein refers to delivering to a subject a composition described herein, e.g., a chimeric polypeptide. The composition, e.g., the chimeric polypeptide, can be administered to a subject using methods known in the art. In particular, the composition can be administered intravenously, subcutaneously, intramuscularly, intradermally, or via any mucosal surface, e.g., orally, sublingually, buccally, nasally, rectally, vaginally or via pulmonary route. chimeric polypeptide. In some embodiments, the administration is self-administration. In some embodiments, a parent administers the chimeric polypeptide to a child. In some embodiments, the chimeric polypeptide is administered to a subject by a healthcare practitioner such as a medical doctor, a medic, or a nurse.

As used herein, the term "dose" refers to a single administration of a composition to a subject. A single dose can be administered all at once, e.g., as a bullous, or over a period of time, e.g., via an intravenous infusion. The term "multiple doses" means more than one dose, e.g., more than one administration.

When referring to co-administration of more than one composition, a dose of composition A can be administered concurrently with a dose of composition B. Alternatively, a dose of composition A can be administered before or after a dose of composition B. In some embodiments, composition A and composition B are combined into a single formulation.

As used herein, the term "interval" or "dosing interval" refers to the amount of time that elapses between a first dose of composition A and a subsequent dose of the same composition administered to a subject. A dosing interval can refer to the time that elapses between a first dose and a second dose, or a dosing interval can refer to the amount of time that elapses between multiple doses.

The term "dosing frequency" as used herein refers to the number of doses administered per a specific dosing interval. For example, a dosing frequency can be written as once a week, once every two weeks, etc. Therefore, a dosing interval of 7 days can be also written as a dosing interval of once in 7 days or once every week, or once a week.

As used herein the term "prophylactic treatment" refers to the administration of a therapy for the treatment of hemophilia, where such treatment is intended to prevent or reduce the severity of one or more symptoms of hemophilia, e.g., bleeding episodes, e.g., one or more spontaneous bleeding episodes, and/or joint damage. See Jimenez-Yuste et al., Blood Transfus. 12(3):314-19 (2014). To prevent or reduce the severity of such symptoms, e.g., bleeding episodes and the progression of joint disease, hemophilia A patients may receive regular infusions of clotting factor as part of a prophylactic treatment regimen. The basis of such prophylactic treatment is the observation that hemophilia patients with a clotting factor, e.g., FVIII, level of 1% or more rarely experience spontaneous bleeding episodes and have fewer hemophilia-related comorbidities as compared to patients with severe hemophilia. See, e.g., Coppola A. et al, Semin. Thromb. Hemost. 38(1): 79-94 (2012). Health care practitioners treating these hemophilia patients surmised that maintaining factor levels at around 1% with regular infusions could potentially reduce the risk of hemophilia symptoms, including bleeding episodes and joint damage. See id. Subsequent research has confirmed these benefits in pediatric hemophilia patients receiving prophylactic treatment with clotting factor, rendering prophylactic treatment the goal for people with severe hemophilia. See id.

A "prophylactic" treatment can also refer to the preemptive administration of the composition described herein, e.g., a chimeric polypeptide, to a subject in order to control, manage, prevent, or reduce the occurrence or severity of one or more symptoms of hemophilia A, e.g., bleeding episodes. Prophylactic treatment with a clotting factor, e.g., FVIII, is the standard of care for subjects with severe hemophilia A. See, e.g., Oldenburg, Blood 125:2038-44 (2015). In some embodiments, prophylactic treatment refers to administering a composition disclosed herein to a subject in need thereof to reduce the occurrence of one or more symptom of hemophilia A. A prophylactic treatment can include administration of multiple doses. The multiple doses used in prophylactic treatment are typically administered at particular dosing intervals. In certain embodiments, the annualized bleeding rate can be reduced to less than 10, less than 9, less than 8, less than 7, less than 6, less than 5, less than 4, less than 3, less than 2, or less than 1.

The term "on-demand treatment" or "episodic treatment" refers to the "as needed" administration of a chimeric molecule in response to symptoms of hemophilia A, e.g., a bleeding episode, or before an activity that can cause bleeding. In one aspect, the on-demand treatment can be given to a subject when bleeding starts, such as after an injury, or when bleeding is expected, such as before surgery. In another aspect, the on-demand treatment can be given prior to activities that increase the risk of bleeding, such as contact sports. In some embodiments, the on-demand treatment is given as a single dose. In other embodiments, the on-demand treatment is given as a first dose, followed by one or more additional doses. When the chimeric polypeptide is administered on-demand, the one or more additional doses can be administered at least about 12 hours, at least about 24 hours, at least about 36 hours, at least about 48 hours, at least about 60 hours, at least about 72 hours, at least about 84 hours, at least about 96 hours, at least about 108 hours, or at least about 120 hours after the first dose. It should be noted, however, that the dosing interval associated with on-demand treatment is not the same as the dosing interval used for prophylactic treatment.

In some embodiments, the subject in need of a general hemostatic agent is undergoing, or is about to undergo, surgery. The chimeric polypeptide of the disclosure can be administered prior to or after surgery. The chimeric polypeptide of the disclosure can also be administered during or after surgery to control an acute bleeding episode. When the chimeric polypeptide is administered prior to surgery, the administration can be at least about 1 hour, at least about 2 hours, at least about 4 hours, at least about 8 hours, at least about 12 hours, at least about 24 hours, at least about 36 hours, at least about 48 hours, or at least about 72 hours prior to surgery. When the chimeric polypeptide is administered to after surgery, the administration can be at least about 1 hour, at least about 2 hours, at least about 4 hours, at least about 8 hours, at least about 12 hours, at least about 24 hours, at least about 36 hours, at least about 48 hours, or at least about 72 hours after surgery. The surgery can include, but is not limited to, liver transplantation, liver resection, dental procedures, or stem cell transplantation.

As used herein the term "acute bleeding" refers to a bleeding episode regardless of the underlying cause. For example, a subject can have trauma, uremia, a hereditary bleeding disorder (e.g., factor VII deficiency) a platelet disorder, or resistance owing to the development of antibodies to clotting factors.

"Treat", "treatment", "treating", as used herein refers to, e.g., the reduction in severity of a disease or condition; the reduction in the duration of a disease course; the amelioration of one or more symptoms associated with a disease or condition; the provision of beneficial effects to a subject with a disease or condition, without necessarily curing the disease or condition, or the prophylaxis of one or more symptoms associated with a disease or condition. In some embodiments, the term "treating" or "treatment" means maintaining a FVIII trough level at least about 1 IU/dL, 2 IU/dL, 3 IU/dL, 4 IU/dL, 5 IU/dL, 6 IU/dL, 7 IU/dL, 8 IU/dL, 9 IU/dL, 10 IU/dL, 11 IU/dL, 12 IU/dL, 13 IU/dL, 14 IU/dL, 15 IU/dL, 16 IU/dL, 17 IU/dL, 18 IU/dL, 19 IU/dL, or 20 IU/dL in a subject by administering a chimeric polypeptide or a VWF fragment of the disclosure. As used herein, a "trough level" in a hemophilia patient is the measurement of the lowest concentration reached by a factor therapy, e.g., a FVIII therapy, before the next dose is administered. In other embodiments, treating or treatment means maintaining a FVIII trough level of at least about 1 IU/dL between the dosing interval. In other embodiments, treating or treatment means maintaining a FVIII trough level of at least about 3 IU/dL between the dosing interval. In other embodiments, treating or treatment means maintaining a FVIII trough level of at least about 5 IU/dL between the dosing interval. In other embodiments, treating or treatment means maintaining a FVIII trough level between about 1 and about 20 IU/dL, about 2 and about 20 IU/dL, about 3 and about 20 IU/dL, about 4 and about 20 IU/dL, about 5 and about 20 IU/dL, about 6 and about 20 IU/dL, about 7 and about 20 IU/dL, about 8 and about 20 IU/dL, about 9 and about 20 IU/dL, or about 10 and about 20 IU/dL during the dosing interval.

"Treatment" or "treating" of a disease or condition can also include maintaining FVIII activity in a subject at a level comparable to at least about 1%, 2%, 3%, 4%, 5%, 6%, 7%, 8%, 9%, 10%, 11%, 12%, 13%, 14%, 15%, 16%, 17%, 18%, 19%, or 20% of the FVIII activity in a non-hemophiliac subject between the dosing interval. In other embodiments, treating or treatment means maintaining a FVIII activity level of at least about 1% between the dosing interval. In other embodiments, treating or treatment means maintaining a FVIII activity level of at least about 2% between the dosing interval. In other embodiments, treating or treatment means maintaining a FVIII activity level of at least about 3% between the dosing interval. In other embodiments, treating or treatment means maintaining a FVIII activity level of at least about 4% between the dosing interval. In other embodiments, treating or treatment means maintaining a FVIII activity level of at least about 5%. between the dosing interval. In other embodiments, treating or treatment means maintaining a FVIII activity level of at least about 6% between the dosing interval. In other embodiments, treating or treatment means maintaining a FVIII activity level of at least about 7% between the dosing interval. In other embodiments, treating or treatment means maintaining a FVIII activity level of at least about 8% between the dosing interval. In other embodiments, treating or treatment means maintaining a FVIII activity level of at least about 9% between the dosing interval. In other embodiments, treating or treatment means maintaining a FVIII activity level of at least about 10% between the dosing interval. The minimum trough level required for treatment can be measured by one or more known methods (for example, the aPTT assays or chromogenic assays described herein) and can be adjusted (increased or decreased) for each person.

II. Methods of the Disclosure

Certain aspects of the present disclosure are directed to methods of treating hemophilia A in a subject in need thereof, comprising administering to the subject a chimeric polypeptide comprising a FVIII protein and a VWF fragment at a dosing interval. In some embodiments, the method comprises administering to the subject multiple doses of a chimeric polypeptide, e.g., rFVIIIFc-VWF-XTEN, comprising (i) a FVIII protein and (ii) a VWF fragment comprising a D' domain of VWF and a D3 domain of VWF at a dosing interval. In other aspects, the present disclosure is directed to methods of treating a bleeding disease or condition, e.g., hemophilia A, in a subject in need thereof, comprising administering to the subject multiple doses of a FVIII protein and multiple doses of a VWF fragment at a dosing interval.

In some embodiments, the multiple doses comprise at least two doses, at least three doses, at least four doses, at least five doses, at least six doses, at least seven doses, at least eight doses, at least nine doses, at least ten doses, at least eleven doses, at least twelve doses, at least thirteen doses, at least fourteen doses, at least fifteen doses, at least sixteen doses, at least seventeen doses, at least eighteen doses, at least nineteen doses, at least twenty doses, or more. In some embodiments, the multiple doses are administered for at least about 1 month, at least about 2 months, at least about 3 months, at least about 4 months, at least about 5 months, at least about 6 months, at least about 12 months, at least about 18 months, at least about 2 years, at least about 3 years, at least about 4 years, at least about 5 years, at least about 10 years, at least about 15 years, at least about 20 years, or for at least about 25 years.

In certain embodiments, the methods of the present disclosure are directed to treating hemophilia A. In some embodiments, the treatment of hemophilia A comprises preventing a bleeding episode in a human subject in need thereof. In some embodiments, the treatment of hemophilia A comprises treating a bleeding episode in a human subject in need thereof. In some embodiments, the treatment of hemophilia A comprises controlling the incidence or frequency of a bleeding episode in a human subject in need thereof. In some embodiments, the treatment of hemophilia A comprises decreasing the incidence or frequency of a bleeding episode in a human subject in need thereof.

A. Doses

In some embodiments, the chimeric polypeptide, e.g., rFVIIIFc-VWF-XTEN, is administered as a single dose or as multiple doses. In some embodiments, the amounts of each of the multiple doses are the same. In other embodiments, one or more of the multiple doses is different from one or more of the other multiple doses. In some embodiments, at least one of the multiple doses of the chimeric polypeptide is from about 5 IU/kg to about 200 IU/kg or from about 10 IU/kg to about 150 IU/kg. In certain embodiments, at least one of the multiple doses is from about 15 IU/kg to about 100 IU/kg. In some embodiments, at least one of the multiple doses is from about 20 IU/kg to about 95 IU/kg, from about 20 IU/kg to about 90 IU/kg, from about 20 IU/kg to about 85 IU/kg, from about 20 IU/kg to about 80 IU/kg, from about 20 IU/kg to about 75 IU/kg, from about 20 IU/kg to about 70 IU/kg, from about 20 IU/kg to about 65 IU/kg, from about 20 IU/kg to about 60 IU/kg, from about 20 IU/kg to about 55 IU/kg, from about 20 IU/kg to about 50 IU/kg, from about 20 IU/kg to about 45 IU/kg, from about 20 IU/kg to about 40 IU/kg, from about 20 IU/kg to about 35 IU/kg, from about 20 IU/kg to about 30 IU/kg, or from about 20 IU/kg to about 25 IU/kg.

In some embodiments, at least one of the multiple doses is from about 20 IU/kg to about 100 IU/kg, from about 25 IU/kg to about 100 IU/kg, from about 30 IU/kg to about 100 IU/kg, from about 35 IU/kg to about 100 IU/kg, from about 40 IU/kg to about 100 IU/kg, from about 45 IU/kg to about 100 IU/kg, from about 50 IU/kg to about 100 IU/kg, from about 55 IU/kg to about 100 IU/kg, from about 60 IU/kg to about 100 IU/kg, from about 65 IU/kg to about 100 IU/kg, from about 70 IU/kg to about 100 IU/kg, from about 75 IU/kg to about 100 IU/kg, from about 80 IU/kg to about 100 IU/kg, from about 85 IU/kg to about 100 IU/kg, or from about 90 IU/kg to about 100 IU/kg. In some embodiments, at least one of the multiple doses is from about 25 IU/kg to about 65 IU/kg.

In some embodiments, at least one of the multiple doses of the chimeric polypeptide is from about 50 IU/kg to about 150 IU/kg, from about 50 IU/kg to about 140 IU/kg, from about 50 IU/kg to about 130 IU/kg, from about 50 IU/kg to about 120 IU/kg, from about 50 IU/kg to about 110 IU/kg, or from about 50 IU/kg to about 100 IU/kg. In some embodiments, at least one of the multiple doses of the chimeric polypeptide is from about 50 IU/kg to about 95 IU/kg, from about 50 IU/kg to about 90 IU/kg, from about 50 IU/kg to about 85 IU/kg, from about 50 IU/kg to about 80 IU/kg, from about 50 IU/kg to about 75 IU/kg, from about 50 IU/kg to about 70 IU/kg, from about 50 IU/kg to about 65 IU/kg, from about 50 IU/kg to about 60 IU/kg, from about 50 IU/kg to about 55 IU/kg. In certain embodiments, at least one of the multiple doses of the chimeric polypeptide is from about 50 IU/kg to about 80 IU/kg. In certain embodiments, at least one of the multiple doses of the chimeric polypeptide is from about 50 IU/kg to about 65 IU/kg.

In some embodiments, at least one of the multiple doses of the chimeric polypeptide is from about 60 IU/kg to about 150 IU/kg, from about 60 IU/kg to about 140 IU/kg, from about 60 IU/kg to about 130 IU/kg, from about 60 IU/kg to about 120 IU/kg, from about 60 IU/kg to about 110 IU/kg, or from about 60 IU/kg to about 100 IU/kg. In some embodiments, at least one of the multiple doses of the chimeric polypeptide is from about 60 IU/kg to about 95 IU/kg, from about 60 IU/kg to about 90 IU/kg, from about 60 IU/kg to about 85 IU/kg, from about 60 IU/kg to about 80 IU/kg, from about 60 IU/kg to about 75 IU/kg, from about 60 IU/kg to about 70 IU/kg, or from about 60 IU/kg to about 65 IU/kg.

In some embodiments, at least one of the multiple doses of the chimeric polypeptide is from about 65 IU/kg to about 150 IU/kg, from about 65 IU/kg to about 140 IU/kg, from about 65 IU/kg to about 130 IU/kg, from about 65 IU/kg to about 120 IU/kg, from about 65 IU/kg to about 110 IU/kg, or from about 65 IU/kg to about 100 IU/kg. In some embodiments, at least one of the multiple doses of the chimeric polypeptide is from about 65 IU/kg to about 95 IU/kg, from about 65 IU/kg to about 90 IU/kg, from about 65 IU/kg to about 85 IU/kg, from about 65 IU/kg to about 80 IU/kg, from about 65 IU/kg to about 75 IU/kg, or from about 65 IU/kg to about 70 IU/kg. In certain embodiments, at least one of the multiple doses of the chimeric polypeptide is from about 65 IU/kg to about 80 IU/kg.

In some embodiments, at least one of the multiple doses is about 5 IU/kg, about 10 IU/kg, about 15 IU/kg, about 20 IU/kg, about 25 IU/kg, about 30 IU/kg, about 35 IU/kg, about 40 IU/kg, about 45 IU/kg, about 50 IU/kg, about 55 IU/kg, about 60 IU/kg, about 65 IU/kg, about 70 IU/kg, about 75 IU/kg, about 80 IU/kg, about 85 IU/kg, about 90 IU/kg, about 95 IU/kg, about 100 IU/kg, about 125 IU/kg, about 150 IU/kg, about 175 IU/kg, or about 200 IU/kg. In certain embodiments, at least one of the multiple doses is about 25 IU/kg. In certain embodiments, at least one of the multiple doses is about 30 IU/kg. In certain embodiments, at least one of the multiple doses is about 35 IU/kg. In certain embodiments, at least one of the multiple doses is about 40 IU/kg. In certain embodiments, at least one of the multiple doses is about 45 IU/kg. In certain embodiments, at least one of the multiple doses is about 50 IU/kg. In certain embodiments, at least one of the multiple doses is about 55 IU/kg. In certain embodiments, at least one of the multiple doses is about 60 IU/kg. In certain embodiments, at least one of the multiple doses is about 65 IU/kg. In certain embodiments, at least one of the multiple doses is about 70 IU/kg. In certain embodiments, at least one of the multiple doses is about 75 IU/kg. In certain embodiments, at least one of the multiple doses is about 80 IU/kg. In certain embodiments, at least one of the multiple doses is about 85 IU/kg. In certain embodiments, at least one of the multiple doses is about 90 IU/kg. In certain embodiments, at least one of the multiple doses is about 95 IU/kg. In certain embodiments, at least one of the multiple doses is about 100 IU/kg.

In some embodiments, each dose of the multiple doses is about 25 IU/kg. In some embodiments, each dose of the multiple doses is about 30 IU/kg. In some embodiments, each dose of the multiple doses is about 35 IU/kg. In some embodiments, each dose of the multiple doses is about 40 IU/kg. In some embodiments, each dose of the multiple doses is about 45 IU/kg. In some embodiments, each dose of the multiple doses is about 50 IU/kg. In some embodiments, each dose of the multiple doses is about 55 IU/kg. In some embodiments, each dose of the multiple doses is about 60 IU/kg. In some embodiments, each dose of the multiple doses is about 65 IU/kg. In some embodiments, each dose of the multiple doses is about 70 IU/kg. In some embodiments, each dose of the multiple doses is about 75 IU/kg. In some embodiments, each dose of the multiple doses is about 80 IU/kg. In some embodiments, each dose of the multiple doses is about 85 IU/kg. In some embodiments, each dose of the multiple doses is about 90 IU/kg. In some embodiments, each dose of the multiple doses is about 95 IU/kg. In some embodiments, each dose of the multiple doses is about 100 IU/kg.

In some embodiments, the chimeric polypeptide, e.g., rFVIIIFc-VWF-XTEN, is administered prophylactically. When administered prophylactically, at least one of the multiple doses can be from about 15 IU/kg to about 100 IU/kg. In certain embodiments, at least one of the multiple doses administered prophylactically is about 25 IU/kg, about 30 IU/kg, about 35 IU/kg, about 40 IU/kg, about 45 IU/kg, about 50 IU/kg, about 55 IU/kg, about 60 IU/kg, about 65 IU/kg, about 70 IU/kg, about 75 IU/kg, about 80 IU/kg, about 85 IU/kg, about 90 IU/kg, about 95 IU/kg, or about 100 IU/kg. In some embodiments, at least one of the multiple doses administered prophylactically is about 25 IU/kg. In other embodiments, at least one of the multiple doses administered prophylactically is about 50 IU/kg. In other embodiments, at least one of the multiple doses administered prophylactically is about 65 IU/kg. In other embodiments, at least one of the multiple doses administered prophylactically is about 80 IU/kg.

In some embodiments, the chimeric polypeptide, e.g., rFVIIIFc-VWF-XTEN, is administered on-demand. When administered on-demand, the chimeric polypeptide can be administered as a single dose or as multiple doses. In some embodiments, the chimeric polypeptide is administered as one or more doses of from about 15 IU/kg to about 100 IU/kg. In certain embodiments, the chimeric polypeptide is administered on-demand as one or more doses of about 25 IU/kg, about 30 IU/kg, about 35 IU/kg, about 40 IU/kg, about 45 IU/kg, about 50 IU/kg, about 55 IU/kg, about 60 IU/kg, about 65 IU/kg, about 70 IU/kg, about 75 IU/kg, about 80 IU/kg, about 85 IU/kg, about 90 IU/kg, about 95 IU/kg, or about 100 IU/kg. In some embodiments, the chimeric polypeptide is administered on-demand as one or more doses of about 25 IU/kg. In other embodiments, the chimeric polypeptide is administered on-demand as one or more doses of about 50 IU/kg. In other embodiments, the chimeric polypeptide is administered on-demand as one or more doses of about 65 IU/kg. In other embodiments, the chimeric polypeptide is administered on-demand as one or more doses of about 80 IU/kg.

In some embodiments, the administration of the chimeric polypeptide according to the present methods induces no FVIII inhibitor after about 7 days, about 10 days, about 11 days, about 12 days, about 13 days, about 14 days, about 15 days, about 20 days, about 24 days, about 25 days, about 28 days, about 30 days, or about 35 days of the administration. In some embodiments, the administration of the chimeric polypeptide induces no FVIII inhibitor after about 28 days of the administration.

B. Dosing Interval

In certain embodiments, especially for prophylactic treatment, the chimeric polypeptide, e.g., rFVIIIFc-VWF-XTEN, is administered as multiple doses at a dosing interval. In some embodiments, the dosing interval is at least about 3 days, at least about 4 days, at least about 5 days, at least about 6 days, at least about 7 days, at least about 8 days, at least about 9 days, at least about 10 days, at least about 11 days, at least about 12 days, at least about 13 days, at least about 14 days, at least about 15 days, at least about 16 days, at least about 17 days, at least about 18 days, at least about 19 days, at least about 20 days, at least about 21 days, at least about 22 days, at least about 23 days, at least about 24 days, at least about 25 days, at least about 26 days, at least about 27 days, at least about 28 days, at least about 29 days, at least about 30 days, or at least about 31 days.

In certain embodiments, the dosing interval, e.g., for prophylactic treatment of hemophilia A, is at least about 5 days. In certain embodiments, the dosing interval, e.g., for prophylactic treatment of hemophilia A, is at least about 6 days. In certain embodiments, the dosing interval, e.g., for prophylactic treatment of hemophilia A, is at least about 7 days. In certain embodiments, the dosing interval, e.g., for prophylactic treatment of hemophilia A, is at least about 8 days. In certain embodiments, the dosing interval, e.g., for prophylactic treatment of hemophilia A, is at least about 9 days. In certain embodiments, the dosing interval is at least about 10 days. In certain embodiments, the dosing interval, e.g., for prophylactic treatment of hemophilia A, is at least about 11 days. In certain embodiments, the dosing interval, e.g., for prophylactic treatment of hemophilia A, is at least about 12 days. In certain embodiments, the dosing interval, e.g., for prophylactic treatment of hemophilia A, is at least about 13 days. In certain embodiments, the dosing interval, e.g., for prophylactic treatment of hemophilia A, is at least about 14 days. In certain embodiments, the dosing interval, e.g., for prophylactic treatment of hemophilia A, is at least about 21 days. In certain embodiments, the dosing interval, e.g., for prophylactic treatment of hemophilia A, is at least about 27 days. In certain embodiments, the dosing interval, e.g., for prophylactic treatment of hemophilia A, is at least about 30 days.

In some embodiments, the dosing frequency, e.g., for prophylactic treatment of hemophilia A, is at least twice every week, at least once every week, at least once every 2 weeks, at least once every 3 weeks, at least once every 4 weeks, at least once every 5 weeks, or at least once every 6 weeks. In certain embodiments, the dosing interval, e.g., for prophylactic treatment of hemophilia A, is at least once every week. In certain embodiments, the dosing interval, e.g., for prophylactic treatment of hemophilia A, is at least 2 weeks. In certain embodiments, the dosing interval, e.g., for prophylactic treatment of hemophilia A, is at least 3 weeks. In certain embodiments, the dosing interval, e.g., for prophylactic treatment of hemophilia A, is at least 4 weeks.

In some embodiments, the dosing frequency, e.g., for prophylactic treatment of hemophilia A, is about 2 times every three months, about 1 time every month, about 2 times every month, about 3 times every month, about 4 times every month, about 5 times every month, about 6 times every month, about 7 times every month, or about 8 times every month. In certain embodiments, the dosing frequency is about 1 time every month. In certain embodiments, the dosing frequency is about 2 times every month. In certain embodiments, the dosing frequency is about 3 times every month. In certain embodiments, the dosing frequency is about 4 times every month. In certain embodiments, the dosing frequency is about 5 times every month. In certain embodiments, the dosing frequency is about 6 times every month.

In some embodiments, the dosing interval, e.g., for prophylactic treatment of hemophilia A, is at least about 3 to 5 days. In some embodiments, the dosing interval, e.g., for prophylactic treatment of hemophilia A, is at least about 4 to 6 days. In some embodiments, the dosing interval, e.g., for prophylactic treatment of hemophilia A, is at least about 4 to 7 days. In some embodiments, the dosing interval, e.g., for prophylactic treatment of hemophilia A, is at least about 4 to 8 days. In some embodiments, the dosing interval, e.g., for prophylactic treatment of hemophilia A, is at least about 4 to 9 days. In some embodiments, the dosing interval, e.g., for prophylactic treatment of hemophilia A, is at least about 4 to 10 days. In some embodiments, the dosing interval, e.g., for prophylactic treatment of hemophilia A, is at least about 5 to 7 days. In some embodiments, the dosing interval, e.g., for prophylactic treatment of hemophilia A, is at least about 5 to 8 days. In some embodiments, the dosing interval, e.g., for prophylactic treatment of hemophilia A, is at least about 5 to 9 days. In some embodiments, the dosing interval, e.g., for prophylactic treatment of hemophilia A, is at least about 5 to 10 days. In some embodiments, the dosing interval, e.g., for prophylactic treatment of hemophilia A, is at least about 6 to 8 days. In some embodiments, the dosing interval, e.g., for prophylactic treatment of hemophilia A, is at least about 6 to 9 days. In some embodiments, the dosing interval, e.g., for prophylactic treatment of hemophilia A, is at least about 6 to 10 days. In some embodiments, the dosing interval, e.g., for prophylactic treatment of hemophilia A, is at least about 7 to 9 days. In some embodiments, the dosing interval, e.g., for prophylactic treatment of hemophilia A, is at least about 7 to 10 days. In some embodiments, the dosing interval, e.g., for prophylactic treatment of hemophilia A, is at least about 7 to 11 days. In some embodiments, the dosing interval, e.g., for prophylactic treatment of hemophilia A, is at least about 7 to 12 days. In some embodiments, the dosing interval, e.g., for prophylactic treatment of hemophilia A, is at least about 7 to 13 days. In some embodiments, the dosing interval, e.g., for prophylactic treatment of hemophilia A, is at least about 7 to 14 days. In some embodiments, the dosing interval, e.g., for prophylactic treatment of hemophilia A, is at least about 8 to 14 days. In some embodiments, the dosing interval, e.g., for prophylactic treatment of hemophilia A, is at least about 9 to 14 days. In some embodiments, the dosing interval, e.g., for prophylactic treatment of hemophilia A, is at least about 10 to 14 days. In some embodiments, the dosing interval, e.g., for prophylactic treatment of hemophilia A, is at least about 11 to 14 days. In some embodiments, the dosing interval, e.g., for prophylactic treatment of hemophilia A, is at least about 10 to 21 days. In some embodiments, the dosing interval, e.g., for prophylactic treatment of hemophilia A, is at least about 12 to 14 days. In some embodiments, the dosing interval, e.g., for prophylactic treatment of hemophilia A, is at least about 12 to 15 days. In some embodiments, the dosing interval, e.g., for prophylactic treatment of hemophilia A, is at least about 13 to 15 days. In some embodiments, the dosing interval, e.g., for prophylactic treatment of hemophilia A, is at least about 14 to 21 days.

In some embodiments, at least one of the multiple doses is administered according to a dose and dosing frequency described in Table 1.

TABLE 1A

Dosing amounts and corresponding dosing frequency, e.g., for prophylactic treatment of hemophilia.

| | 5 IU/kg | 10 IU/kg | 15 IU/kg | 20 IU/kg | 25 IU/kg | 30 IU/kg | 35 IU/kg | 40 IU/kg | 45 IU/kg | 50 IU/kg |
|---|---|---|---|---|---|---|---|---|---|---|
| 5 days | 5 IU/kg Every 5 days | 10 IU/kg Every 5 days | 15 IU/kg Every 5 days | 20 IU/kg Every 5 days | 25 IU/kg Every 5 days | 30 IU/kg Every 5 days | 35 IU/kg Every 5 days | 40 IU/kg Every 5 days | 45 IU/kg Every 5 days | 50 IU/kg Every 5 days |
| 6 days | 5 IU/kg Every 6 days | 10 IU/kg Every 6 days | 15 IU/kg Every 6 days | 20 IU/kg Every 6 days | 25 IU/kg Every 6 days | 30 IU/kg Every 6 days | 35 IU/kg Every 6 days | 40 IU/kg Every 6 days | 45 IU/kg Every 6 days | 50 IU/kg Every 6 days |
| 7 days | 5 IU/kg Every 7 days | 10 IU/kg Every 7 days | 15 IU/kg Every 7 days | 20 IU/kg Every 7 days | 25 IU/kg Every 7 days | 30 IU/kg Every 7 days | 35 IU/kg Every 7 days | 40 IU/kg Every 7 days | 45 IU/kg Every 7 days | 50 IU/kg Every 7 days |
| 8 days | 5 IU/kg Every 8 days | 10 IU/kg Every 8 days | 15 IU/kg Every 8 days | 20 IU/kg Every 8 days | 25 IU/kg Every 8 days | 30 IU/kg Every 8 days | 35 IU/kg Every 8 days | 40 IU/kg Every 8 days | 45 IU/kg Every 8 days | 50 IU/kg Every 8 days |
| 9 days | 5 IU/kg Every 9 days | 10 IU/kg Every 9 days | 15 IU/kg Every 9 days | 20 IU/kg Every 9 days | 25 IU/kg Every 9 days | 30 IU/kg Every 9 days | 35 IU/kg Every 9 days | 40 IU/kg Every 9 days | 45 IU/kg Every 9 days | 50 IU/kg Every 9 days |
| 10 days | 5 IU/kg Every 10 days | 10 IU/kg Every 10 days | 15 IU/kg Every 10 days | 20 IU/kg Every 10 days | 25 IU/kg Every 10 days | 30 IU/kg Every 10 days | 35 IU/kg Every 10 days | 40 IU/kg Every 10 days | 45 IU/kg Every 10 days | 50 IU/kg Every 10 days |
| 11 days | 5 IU/kg Every 11 days | 10 IU/kg Every 11 days | 15 IU/kg Every 11 days | 20 IU/kg Every 11 days | 25 IU/kg Every 11 days | 30 IU/kg Every 11 days | 35 IU/kg Every 11 days | 40 IU/kg Every 11 days | 45 IU/kg Every 11 days | 50 IU/kg Every 11 days |
| 12 days | 5 IU/kg Every 12 days | 10 IU/kg Every 12 days | 15 IU/kg Every 12 days | 20 IU/kg Every 12 days | 25 IU/kg Every 12 days | 30 IU/kg Every 12 days | 35 IU/kg Every 12 days | 40 IU/kg Every 12 days | 45 IU/kg Every 12 days | 50 IU/kg Every 12 days |
| 13 days | 5 IU/kg Every 13 days | 10 IU/kg Every 13 days | 15 IU/kg Every 13 days | 20 IU/kg Every 13 days | 25 IU/kg Every 13 days | 30 IU/kg Every 13 days | 35 IU/kg Every 13 days | 40 IU/kg Every 13 days | 45 IU/kg Every 13 days | 50 IU/kg Every 13 days |
| 14 days | 5 IU/kg Every 14 days | 10 IU/kg Every 14 days | 15 IU/kg Every 14 days | 20 IU/kg Every 14 days | 25 IU/kg Every 14 days | 30 IU/kg Every 14 days | 35 IU/kg Every 14 days | 40 IU/kg Every 14 days | 45 IU/kg Every 14 days | 50 IU/kg Every 14 days |
| 15 days | 5 IU/kg Every 15 days | 10 IU/kg Every 15 days | 15 IU/kg Every 15 days | 20 IU/kg Every 15 days | 25 IU/kg Every 15 days | 30 IU/kg Every 15 days | 35 IU/kg Every 15 days | 40 IU/kg Every 15 days | 45 IU/kg Every 15 days | 50 IU/kg Every 15 days |
| 16 days | 5 IU/kg Every 16 days | 10 IU/kg Every 16 days | 15 IU/kg Every 16 days | 20 IU/kg Every 16 days | 25 IU/kg Every 16 days | 30 IU/kg Every 16 days | 35 IU/kg Every 16 days | 40 IU/kg Every 16 days | 45 IU/kg Every 16 days | 50 IU/kg Every 16 days |
| 17 days | 5 IU/kg Every 17 days | 10 IU/kg Every 17 days | 15 IU/kg Every 17 days | 20 IU/kg Every 17 days | 25 IU/kg Every 17 days | 30 IU/kg Every 17 days | 35 IU/kg Every 17 days | 40 IU/kg Every 17 days | 45 IU/kg Every 17 days | 50 IU/kg Every 17 days |
| 18 days | 5 IU/kg Every 18 days | 10 IU/kg Every 18 days | 15 IU/kg Every 18 days | 20 IU/kg Every 18 days | 25 IU/kg Every 18 days | 30 IU/kg Every 18 days | 35 IU/kg Every 18 days | 40 IU/kg Every 18 days | 45 IU/kg Every 18 days | 50 IU/kg Every 18 days |
| 19 days | 5 IU/kg Every 19 days | 10 IU/kg Every 19 days | 15 IU/kg Every 19 days | 20 IU/kg Every 19 days | 25 IU/kg Every 19 days | 30 IU/kg Every 19 days | 35 IU/kg Every 19 days | 40 IU/kg Every 19 days | 45 IU/kg Every 19 days | 50 IU/kg Every 19 days |
| 20 days | 5 IU/kg Every 20 days | 10 IU/kg Every 20 days | 15 IU/kg Every 20 days | 20 IU/kg Every 20 days | 25 IU/kg Every 20 days | 30 IU/kg Every 20 days | 35 IU/kg Every 20 days | 40 IU/kg Every 20 days | 45 IU/kg Every 20 days | 50 IU/kg Every 20 days |
| 21 days | 5 IU/kg Every 21 days | 10 IU/kg Every 21 days | 15 IU/kg Every 21 days | 20 IU/kg Every 21 days | 25 IU/kg Every 21 days | 30 IU/kg Every 21 days | 35 IU/kg Every 21 days | 40 IU/kg Every 21 days | 45 IU/kg Every 21 days | 50 IU/kg Every 21 days |

| | 55 IU/kg | 60 IU/kg | 65 IU/kg | 70 IU/kg | 75 IU/kg | 80 IU/kg | 85 IU/kg | 90 IU/kg | 95 IU/kg | 100 IU/kg |
|---|---|---|---|---|---|---|---|---|---|---|
| 5 days | 55 IU/kg Every 5 days | 60 IU/kg Every 5 days | 65 IU/kg Every 5 days | 70 IU/kg Every 5 days | 75 IU/kg Every 5 days | 80 IU/kg Every 5 days | 85 IU/kg Every 5 days | 90 IU/kg Every 5 days | 95 IU/kg Every 5 days | 100 IU/kg Every 5 days |
| 6 days | 55 IU/kg Every 6 days | 60 IU/kg Every 6 days | 65 IU/kg Every 6 days | 70 IU/kg Every 6 days | 75 IU/kg Every 6 days | 80 IU/kg Every 6 days | 85 IU/kg Every 6 days | 90 IU/kg Every 6 days | 95 IU/kg Every 6 days | 100 IU/kg Every 6 days |
| 7 days | 55 IU/kg Every 7 days | 60 IU/kg Every 7 days | 65 IU/kg Every 7 days | 70 IU/kg Every 7 days | 75 IU/kg Every 7 days | 80 IU/kg Every 7 days | 85 IU/kg Every 7 days | 90 IU/kg Every 7 days | 95 IU/kg Every 7 days | 100 IU/kg Every 7 days |

TABLE 1A-continued

Dosing amounts and corresponding dosing frequency, e.g., for prophylactic treatment of hemophilia.

| | | | | | | | | | | |
|---|---|---|---|---|---|---|---|---|---|---|
| 8 days | 55 IU/kg Every 8 days | 60 IU/kg Every 8 days | 65 IU/kg Every 8 days | 70 IU/kg Every 8 days | 75 IU/kg Every 8 days | 80 IU/kg Every 8 days | 85 IU/kg Every 8 days | 90 IU/kg Every 8 days | 95 IU/kg Every 8 days | 100 IU/kg Every 8 days |
| 9 days | 55 IU/kg Every 9 days | 60 IU/kg Every 9 days | 65 IU/kg Every 9 days | 70 IU/kg Every 9 days | 75 IU/kg Every 9 days | 80 IU/kg Every 9 days | 85 IU/kg Every 9 days | 90 IU/kg Every 9 days | 95 IU/kg Every 9 days | 100 IU/kg Every 9 days |
| 10 days | 55 IU/kg Every 10 days | 60 IU/kg Every 10 days | 65 IU/kg Every 10 days | 70 IU/kg Every 10 days | 75 IU/kg Every 10 days | 80 IU/kg Every 10 days | 85 IU/kg Every 10 days | 90 IU/kg Every 10 days | 95 IU/kg Every 10 days | 100 IU/kg Every 10 days |
| 11 days | 55 IU/kg Every 11 days | 60 IU/kg Every 11 days | 65 IU/kg Every 11 days | 70 IU/kg Every 11 days | 75 IU/kg Every 11 days | 80 IU/kg Every 11 days | 85 IU/kg Every 11 days | 90 IU/kg Every 11 days | 95 IU/kg Every 11 days | 100 IU/kg Every 11 days |
| 12 days | 55 IU/kg Every 12 days | 60 IU/kg Every 12 days | 65 IU/kg Every 12 days | 70 IU/kg Every 12 days | 75 IU/kg Every 12 days | 80 IU/kg Every 12 days | 85 IU/kg Every 12 days | 90 IU/kg Every 12 days | 95 IU/kg Every 12 days | 100 IU/kg Every 12 days |
| 13 days | 55 IU/kg Every 13 days | 60 IU/kg Every 13 days | 65 IU/kg Every 13 days | 70 IU/kg Every 13 days | 75 IU/kg Every 13 days | 80 IU/kg Every 13 days | 85 IU/kg Every 13 days | 90 IU/kg Every 13 days | 95 IU/kg Every 13 days | 100 IU/kg Every 13 days |
| 14 days | 55 IU/kg Every 14 days | 60 IU/kg Every 14 days | 65 IU/kg Every 14 days | 70 IU/kg Every 14 days | 75 IU/kg Every 14 days | 80 IU/kg Every 14 days | 85 IU/kg Every 14 days | 90 IU/kg Every 14 days | 95 IU/kg Every 14 days | 100 IU/kg Every 14 days |
| 15 days | 55 IU/kg Every 15 days | 60 IU/kg Every 15 days | 65 IU/kg Every 15 days | 70 IU/kg Every 15 days | 75 IU/kg Every 15 days | 80 IU/kg Every 15 days | 85 IU/kg Every 15 days | 90 IU/kg Every 15 days | 95 IU/kg Every 15 days | 100 IU/kg Every 15 days |
| 16 days | 55 IU/kg Every 16 days | 60 IU/kg Every 16 days | 65 IU/kg Every 16 days | 70 IU/kg Every 16 days | 75 IU/kg Every 16 days | 80 IU/kg Every 16 days | 85 IU/kg Every 16 days | 90 IU/kg Every 16 days | 95 IU/kg Every 16 days | 100 IU/kg Every 16 days |
| 17 days | 55 IU/kg Every 17 days | 60 IU/kg Every 17 days | 65 IU/kg Every 17 days | 70 IU/kg Every 17 days | 75 IU/kg Every 17 days | 80 IU/kg Every 17 days | 85 IU/kg Every 17 days | 90 IU/kg Every 17 days | 95 IU/kg Every 17 days | 100 IU/kg Every 17 days |
| 18 days | 55 IU/kg Every 18 days | 60 IU/kg Every 18 days | 65 IU/kg Every 18 days | 70 IU/kg Every 18 days | 75 IU/kg Every 18 days | 80 IU/kg Every 18 days | 85 IU/kg Every 18 days | 90 IU/kg Every 18 days | 95 IU/kg Every 18 days | 100 IU/kg Every 18 days |
| 19 days | 55 IU/kg Every 19 days | 60 IU/kg Every 19 days | 65 IU/kg Every 19 days | 70 IU/kg Every 19 days | 75 IU/kg Every 19 days | 80 IU/kg Every 19 days | 85 IU/kg Every 19 days | 90 IU/kg Every 19 days | 95 IU/kg Every 19 days | 100 IU/kg Every 19 days |
| 20 days | 55 IU/kg Every 20 days | 60 IU/kg Every 20 days | 65 IU/kg Every 20 days | 70 IU/kg Every 20 days | 75 IU/kg Every 20 days | 80 IU/kg Every 20 days | 85 IU/kg Every 20 days | 90 IU/kg Every 20 days | 95 IU/kg Every 20 days | 100 IU/kg Every 20 days |
| 21 days | 55 IU/kg Every 21 days | 60 IU/kg Every 21 days | 65 IU/kg Every 21 days | 70 IU/kg Every 21 days | 75 IU/kg Every 21 days | 80 IU/kg Every 21 days | 85 IU/kg Every 21 days | 90 IU/kg Every 21 days | 95 IU/kg Every 21 days | 100 IU/kg Every 21 days |

TABLE 1B

Dosing amounts and corresponding dosing intervals, e.g., for prophylactic treatment of hemophilia.

| | 55 IU/kg | 60 IU/kg | 65 IU/kg | 70 IU/kg | 75 IU/kg | 80 IU/kg | 85 IU/kg | 90 IU/kg | 95 IU/kg | 100 IU/kg |
|---|---|---|---|---|---|---|---|---|---|---|
| 5 days | 55 IU/kg Every 5 days | 60 IU/kg Every 5 days | 65 IU/kg Every 5 days | 70 IU/kg Every 5 days | 75 IU/kg Every 5 days | 80 IU/kg Every 5 days | 85 IU/kg Every 5 days | 90 IU/kg Every 5 days | 95 IU/kg Every 5 days | 100 IU/kg Every 5 days |
| 6 days | 55 IU/kg Every 6 days | 60 IU/kg Every 6 days | 65 IU/kg Every 6 days | 70 IU/kg Every 6 days | 75 IU/kg Every 6 days | 80 IU/kg Every 6 days | 85 IU/kg Every 6 days | 90 IU/kg Every 6 days | 95 IU/kg Every 6 days | 100 IU/kg Every 6 days |
| 7 days | 55 IU/kg Every 7 days | 60 IU/kg Every 7 days | 65 IU/kg Every 7 days | 70 IU/kg Every 7 days | 75 IU/kg Every 7 days | 80 IU/kg Every 7 days | 85 IU/kg Every 7 days | 90 IU/kg Every 7 days | 95 IU/kg Every 7 days | 100 IU/kg Every 7 days |
| 8 days | 55 IU/kg Every 8 days | 60 IU/kg Every 8 days | 65 IU/kg Every 8 days | 70 IU/kg Every 8 days | 75 IU/kg Every 8 days | 80 IU/kg Every 8 days | 85 IU/kg Every 8 days | 90 IU/kg Every 8 days | 95 IU/kg Every 8 days | 100 IU/kg Every 8 days |

TABLE 1B-continued

Dosing amounts and corresponding dosing intervals, e.g., for prophylactic treatment of hemophilia.

| | 55 IU/kg | 60 IU/kg | 65 IU/kg | 70 IU/kg | 75 IU/kg | 80 IU/kg | 85 IU/kg | 90 IU/kg | 95 IU/kg | 100 IU/kg |
|---|---|---|---|---|---|---|---|---|---|---|
| 9 days | 55 IU/kg Every 9 days | 60 IU/kg Every 9 days | 65 IU/kg Every 9 days | 70 IU/kg Every 9 days | 75 IU/kg Every 9 days | 80 IU/kg Every 9 days | 85 IU/kg Every 9 days | 90 IU/kg Every 9 days | 95 IU/kg Every 9 days | 100 IU/kg Every 9 days |
| 10 days | 55 IU/kg Every 10 days | 60 IU/kg Every 10 days | 65 IU/kg Every 10 days | 70 IU/kg Every 10 days | 75 IU/kg Every 10 days | 80 IU/kg Every 10 days | 85 IU/kg Every 10 days | 90 IU/kg Every 10 days | 95 IU/kg Every 10 days | 100 IU/kg Every 10 days |
| 11 days | 55 IU/kg Every 11 days | 60 IU/kg Every 11 days | 65 IU/kg Every 11 days | 70 IU/kg Every 11 days | 75 IU/kg Every 11 days | 80 IU/kg Every 11 days | 85 IU/kg Every 11 days | 90 IU/kg Every 11 days | 95 IU/kg Every 11 days | 100 IU/kg Every 11 days |
| 12 days | 55 IU/kg Every 12 days | 60 IU/kg Every 12 days | 65 IU/kg Every 12 days | 70 IU/kg Every 12 days | 75 IU/kg Every 12 days | 80 IU/kg Every 12 days | 85 IU/kg Every 12 days | 90 IU/kg Every 12 days | 95 IU/kg Every 12 days | 100 IU/kg Every 12 days |
| 13 days | 55 IU/kg Every 13 days | 60 IU/kg Every 13 days | 65 IU/kg Every 13 days | 70 IU/kg Every 13 days | 75 IU/kg Every 13 days | 80 IU/kg Every 13 days | 85 IU/kg Every 13 days | 90 IU/kg Every 13 days | 95 IU/kg Every 13 days | 100 IU/kg Every 13 days |
| 14 days | 55 IU/kg Every 14 days | 60 IU/kg Every 14 days | 65 IU/kg Every 14 days | 70 IU/kg Every 14 days | 75 IU/kg Every 14 days | 80 IU/kg Every 14 days | 85 IU/kg Every 14 days | 90 IU/kg Every 14 days | 95 IU/kg Every 14 days | 100 IU/kg Every 14 days |
| 15 days | 55 IU/kg Every 15 days | 60 IU/kg Every 15 days | 65 IU/kg Every 15 days | 70 IU/kg Every 15 days | 75 IU/kg Every 15 days | 80 IU/kg Every 15 days | 85 IU/kg Every 15 days | 90 IU/kg Every 15 days | 95 IU/kg Every 15 days | 100 IU/kg Every 15 days |
| 16 days | 55 IU/kg Every 16 days | 60 IU/kg Every 16 days | 65 IU/kg Every 16 days | 70 IU/kg Every 16 days | 75 IU/kg Every 16 days | 80 IU/kg Every 16 days | 85 IU/kg Every 16 days | 90 IU/kg Every 16 days | 95 IU/kg Every 16 days | 100 IU/kg Every 16 days |
| 17 days | 55 IU/kg Every 17 days | 60 IU/kg Every 17 days | 65 IU/kg Every 17 days | 70 IU/kg Every 17 days | 75 IU/kg Every 17 days | 80 IU/kg Every 17 days | 85 IU/kg Every 17 days | 90 IU/kg Every 17 days | 95 IU/kg Every 17 days | 100 IU/kg Every 17 days |
| 18 days | 55 IU/kg Every 18 days | 60 IU/kg Every 18 days | 65 IU/kg Every 18 days | 70 IU/kg Every 18 days | 75 IU/kg Every 18 days | 80 IU/kg Every 18 days | 85 IU/kg Every 18 days | 90 IU/kg Every 18 days | 95 IU/kg Every 18 days | 100 IU/kg Every 18 days |
| 19 days | 55 IU/kg Every 19 days | 60 IU/kg Every 19 days | 65 IU/kg Every 19 days | 70 IU/kg Every 19 days | 75 IU/kg Every 19 days | 80 IU/kg Every 19 days | 85 IU/kg Every 19 days | 90 IU/kg Every 19 days | 95 IU/kg Every 19 days | 100 IU/kg Every 19 days |
| 20 days | 55 IU/kg Every 20 days | 60 IU/kg Every 20 days | 65 IU/kg Every 20 days | 70 IU/kg Every 20 days | 75 IU/kg Every 20 days | 80 IU/kg Every 20 days | 85 IU/kg Every 20 days | 90 IU/kg Every 20 days | 95 IU/kg Every 20 days | 100 IU/kg Every 20 days |
| 21 days | 55 IU/kg Every 21 days | 60 IU/kg Every 21 days | 65 IU/kg Every 21 days | 70 IU/kg Every 21 days | 75 IU/kg Every 21 days | 80 IU/kg Every 21 days | 85 IU/kg Every 21 days | 90 IU/kg Every 21 days | 95 IU/kg Every 21 days | 100 IU/kg Every 21 days |
| 5 days | 55 IU/kg Every 5 days | 60 IU/kg Every 5 days | 65 IU/kg Every 5 days | 70 IU/kg Every 5 days | 75 IU/kg Every 5 days | 80 IU/kg Every 5 days | 85 IU/kg Every 5 days | 90 IU/kg Every 5 days | 95 IU/kg Every 5 days | 100 IU/kg Every 5 days |
| 6 days | 55 IU/kg Every 6 days | 60 IU/kg Every 6 days | 65 IU/kg Every 6 days | 70 IU/kg Every 6 days | 75 IU/kg Every 6 days | 80 IU/kg Every 6 days | 85 IU/kg Every 6 days | 90 IU/kg Every 6 days | 95 IU/kg Every 6 days | 100 IU/kg Every 6 days |
| 7 days | 55 IU/kg Every 7 days | 60 IU/kg Every 7 days | 65 IU/kg Every 7 days | 70 IU/kg Every 7 days | 75 IU/kg Every 7 days | 80 IU/kg Every 7 days | 85 IU/kg Every 7 days | 90 IU/kg Every 7 days | 95 IU/kg Every 7 days | 100 IU/kg Every 7 days |
| 8 days | 55 IU/kg Every 8 days | 60 IU/kg Every 8 days | 65 IU/kg Every 8 days | 70 IU/kg Every 8 days | 75 IU/kg Every 8 days | 80 IU/kg Every 8 days | 85 IU/kg Every 8 days | 90 IU/kg Every 8 days | 95 IU/kg Every 8 days | 100 IU/kg Every 8 days |
| 9 days | 55 IU/kg Every 9 days | 60 IU/kg Every 9 days | 65 IU/kg Every 9 days | 70 IU/kg Every 9 days | 75 IU/kg Every 9 days | 80 IU/kg Every 9 days | 85 IU/kg Every 9 days | 90 IU/kg Every 9 days | 95 IU/kg Every 9 days | 100 IU/kg Every 9 days |
| 10 days | 55 IU/kg Every 10 days | 60 IU/kg Every 10 days | 65 IU/kg Every 10 days | 70 IU/kg Every 10 days | 75 IU/kg Every 10 days | 80 IU/kg Every 10 days | 85 IU/kg Every 10 days | 90 IU/kg Every 10 days | 95 IU/kg Every 10 days | 100 IU/kg Every 10 days |
| 11 days | 55 IU/kg Every 11 days | 60 IU/kg Every 11 days | 65 IU/kg Every 11 days | 70 IU/kg Every 11 days | 75 IU/kg Every 11 days | 80 IU/kg Every 11 days | 85 IU/kg Every 11 days | 90 IU/kg Every 11 days | 95 IU/kg Every 11 days | 100 IU/kg Every 11 days |

TABLE 1B-continued

Dosing amounts and corresponding dosing intervals, e.g., for prophylactic treatment of hemophilia.

|  | 55 IU/kg | 60 IU/kg | 65 IU/kg | 70 IU/kg | 75 IU/kg | 80 IU/kg | 85 IU/kg | 90 IU/kg | 95 IU/kg | 100 IU/kg |
|---|---|---|---|---|---|---|---|---|---|---|
| 12 days | 55 IU/kg Every 12 days | 60 IU/kg Every 12 days | 65 IU/kg Every 12 days | 70 IU/kg Every 12 days | 75 IU/kg Every 12 days | 80 IU/kg Every 12 days | 85 IU/kg Every 12 days | 90 IU/kg Every 12 days | 95 IU/kg Every 12 days | 100 IU/kg Every 12 days |
| 13 days | 55 IU/kg Every 13 days | 60 IU/kg Every 13 days | 65 IU/kg Every 13 days | 70 IU/kg Every 13 days | 75 IU/kg Every 13 days | 80 IU/kg Every 13 days | 85 IU/kg Every 13 days | 90 IU/kg Every 13 days | 95 IU/kg Every 13 days | 100 IU/kg Every 13 days |
| 14 days | 55 IU/kg Every 14 days | 60 IU/kg Every 14 days | 65 IU/kg Every 14 days | 70 IU/kg Every 14 days | 75 IU/kg Every 14 days | 80 IU/kg Every 14 days | 85 IU/kg Every 14 days | 90 IU/kg Every 14 days | 95 IU/kg Every 14 days | 100 IU/kg Every 14 days |
| 15 days | 55 IU/kg Every 15 days | 60 IU/kg Every 15 days | 65 IU/kg Every 15 days | 70 IU/kg Every 15 days | 75 IU/kg Every 15 days | 80 IU/kg Every 15 days | 85 IU/kg Every 15 days | 90 IU/kg Every 15 days | 95 IU/kg Every 15 days | 100 IU/kg Every 15 days |
| 16 days | 55 IU/kg Every 16 days | 60 IU/kg Every 16 days | 65 IU/kg Every 16 days | 70 IU/kg Every 16 days | 75 IU/kg Every 16 days | 80 IU/kg Every 16 days | 85 IU/kg Every 16 days | 90 IU/kg Every 16 days | 95 IU/kg Every 16 days | 100 IU/kg Every 16 days |
| 17 days | 55 IU/kg Every 17 days | 60 IU/kg Every 17 days | 65 IU/kg Every 17 days | 70 IU/kg Every 17 days | 75 IU/kg Every 17 days | 80 IU/kg Every 17 days | 85 IU/kg Every 17 days | 90 IU/kg Every 17 days | 95 IU/kg Every 17 days | 100 IU/kg Every 17 days |
| 18 days | 55 IU/kg Every 18 days | 60 IU/kg Every 18 days | 65 IU/kg Every 18 days | 70 IU/kg Every 18 days | 75 IU/kg Every 18 days | 80 IU/kg Every 18 days | 85 IU/kg Every 18 days | 90 IU/kg Every 18 days | 95 IU/kg Every 18 days | 100 IU/kg Every 18 days |
| 19 days | 55 IU/kg Every 19 days | 60 IU/kg Every 19 days | 65 IU/kg Every 19 days | 70 IU/kg Every 19 days | 75 IU/kg Every 19 days | 80 IU/kg Every 19 days | 85 IU/kg Every 19 days | 90 IU/kg Every 19 days | 95 IU/kg Every 19 days | 100 IU/kg Every 19 days |
| 20 days | 55 IU/kg Every 20 days | 60 IU/kg Every 20 days | 65 IU/kg Every 20 days | 70 IU/kg Every 20 days | 75 IU/kg Every 20 days | 80 IU/kg Every 20 days | 85 IU/kg Every 20 days | 90 IU/kg Every 20 days | 95 IU/kg Every 20 days | 100 IU/kg Every 20 days |
| 21 days | 55 IU/kg Every 21 days | 60 IU/kg Every 21 days | 65 IU/kg Every 21 days | 70 IU/kg Every 21 days | 75 IU/kg Every 21 days | 80 IU/kg Every 21 days | 85 IU/kg Every 21 days | 90 IU/kg Every 21 days | 95 IU/kg Every 21 days | 100 IU/kg Every 21 days |

In some embodiments, such as for prophylactic treatment of hemophilia A, at least one of the multiple doses is administered at a dose of about 25 IU/kg to about 65 IU/kg at a dosing interval of at least about 5 to 14 days. In some embodiments, at least one of the multiple doses is administered at a dose of about 25 IU/kg to about 65 IU/kg at a dosing interval of at least about 6 to 14 days. In some embodiments, at least one of the multiple doses is administered at a dose of about 25 IU/kg to about 65 IU/kg at a dosing interval of at least about 6 to 10 days. In some embodiments, at least one of the multiple doses is administered at a dose of about 25 IU/kg to about 65 IU/kg at a dosing interval of at least about 6 to 8 days. In some embodiments, at least one of the multiple doses is administered at a dose of about 25 IU/kg to about 65 IU/kg at a dosing interval of at least about 6 to 9 days. In some embodiments, at least one of the multiple doses is administered at a dose of about 25 IU/kg to about 65 IU/kg at a dosing interval of at least about 6 to 11 days. In some embodiments, at least one of the multiple doses is administered at a dose of about 25 IU/kg to about 65 IU/kg at a dosing interval of at least about 6 to 12 days. In some embodiments, at least one of the multiple doses is administered at a dose of about 25 IU/kg to about 65 IU/kg at a dosing interval of at least about 6 to 13 days. In some embodiments, at least one of the multiple doses is administered at a dose of about 25 IU/kg to about 65 IU/kg at a dosing interval of at least about 7 to 9 days. In some embodiments, at least one of the multiple doses is administered at a dose of about 25 IU/kg to about 65 IU/kg at a dosing interval of at least about 7 to 10 days. In some embodiments, at least one of the multiple doses is administered at a dose of about 25 IU/kg to about 65 IU/kg at a dosing interval of at least about 7 to 11 days. In some embodiments, at least one of the multiple doses is administered at a dose of about 25 IU/kg to about 65 IU/kg at a dosing interval of at least about 7 to 12 days. In some embodiments, at least one of the multiple doses is administered at a dose of about 25 IU/kg to about 65 IU/kg at a dosing interval of at least about 7 to 13 days. In some embodiments, at least one of the multiple doses is administered at a dose of about 25 IU/kg to about 65 IU/kg at a dosing interval of at least about 7 to 14 days. In some embodiments, at least one of the multiple doses is administered at a dose of about 25 IU/kg to about 65 IU/kg at a dosing interval of at least about 8 to 14 days. In some embodiments, at least one of the multiple doses is administered at a dose of about 25 IU/kg to about 65 IU/kg at a dosing interval of at least about 9 to 14 days. In some embodiments, at least one of the multiple doses is administered at a dose of about 25 IU/kg to about 65 IU/kg at a dosing interval of at least about 10 to 14 days. In some embodiments, at least one of the multiple doses is administered at a dose of about 25 IU/kg to about 65 IU/kg at a dosing interval of at least about 10 to 21 days. In some embodiments, at least one of the multiple doses is administered at a dose of about 25 IU/kg to about 65 IU/kg at a dosing interval of at least about 11 to 14 days. In some embodiments, at least one of the multiple doses is administered at a dose of about 25 IU/kg to about 65 IU/kg at a dosing interval of at least about 12 to 14 days. In some embodiments, at least one of the multiple doses is administered at a dose of about 25 IU/kg to about 65 IU/kg at a dosing interval of at least about 12 to 15 days. In some embodiments, at least one of the multiple doses is administered at a dose of about 25 IU/kg to about 65 IU/kg at a dosing interval of at least about 13 to 15 days. In some embodiments, at least one of the multiple doses is administered at a dose of about 25 IU/kg to about 65 IU/kg at a dosing interval of at least about 14 to 21 days.

In some embodiments, such as for prophylactic treatment of hemophilia A, at least one of the multiple doses is administered at a dose of about 25 IU/kg at a dosing interval of at least about 5 to 14 days. In some embodiments, at least one of the multiple doses is administered at a dose of about 25 IU/kg at a dosing interval of at least about 6 to 14 days. In some embodiments, at least one of the multiple doses is administered at a dose of about 25 IU/kg at a dosing interval of at least about 6 to 10 days. In some embodiments, at least one of the multiple doses is administered at a dose of about 25 IU/kg at a dosing interval of at least about 6 to 8 days. In some embodiments, at least one of the multiple doses is administered at a dose of about 25 IU/kg at a dosing interval of at least about 6 to 9 days. In some embodiments, at least one of the multiple doses is administered at a dose of about 25 IU/kg at a dosing interval of at least about 6 to 11 days. In some embodiments, at least one of the multiple doses is administered at a dose of about 25 IU/kg at a dosing interval of at least about 6 to 12 days. In some embodiments, at least one of the multiple doses is administered at a dose of about 25 IU/kg at a dosing interval of at least about 6 to 13 days. In some embodiments, at least one of the multiple doses is administered at a dose of about 25 IU/kg at a dosing interval of at least about 7 to 9 days. In some embodiments, at least one of the multiple doses is administered at a dose of about 25 IU/kg at a dosing interval of at least about 7 to 10 days. In some embodiments, at least one of the multiple doses is administered at a dose of about 25 IU/kg at a dosing interval of at least about 7 to 11 days. In some embodiments, at least one of the multiple doses is administered at a dose of about 25 IU/kg at a dosing interval of at least about 7 to 12 days. In some embodiments, at least one of the multiple doses is administered at a dose of about 25 IU/kg at a dosing interval of at least about 7 to 13 days. In some embodiments, at least one of the multiple doses is administered at a dose of about 25 IU/kg at a dosing interval of at least about 7 to 14 days. In some embodiments, at least one of the multiple doses is administered at a dose of about 25 IU/kg at a dosing interval of at least about 8 to 14 days. In some embodiments, at least one of the multiple doses is administered at a dose of about 25 IU/kg at a dosing interval of at least about 9 to 14 days. In some embodiments, at least one of the multiple doses is administered at a dose of about 25 IU/kg at a dosing interval of at least about 10 to 14 days. In some embodiments, at least one of the multiple doses is administered at a dose of about 25 IU/kg at a dosing interval of at least about 10 to 21 days. In some embodiments, at least one of the multiple doses is administered at a dose of about 25 IU/kg at a dosing interval of at least about 11 to 14 days. In some embodiments, at least one of the multiple doses is administered at a dose of about 25 IU/kg at a dosing interval of at least about 12 to 14 days. In some embodiments, at least one of the multiple doses is administered at a dose of about 25 IU/kg at a dosing interval of at least about 12 to 15 days. In some embodiments, at least one of the multiple doses is administered at a dose of about 25 IU/kg at a dosing interval of at least about 13 to 15 days. In some embodiments, at least one of the multiple doses is administered at a dose of about 25 IU/kg at a dosing interval of at least about 14 to 21 days.

In some embodiments, such as for prophylactic treatment of hemophilia A, at least one of the multiple doses is administered at a dose of about 50 IU/kg at a dosing interval of at least about 5 to 14 days In some embodiments, at least one of the multiple doses is administered at a dose of about 50 IU/kg at a dosing interval of at least about 6 to 14 days. In some embodiments, at least one of the multiple doses is administered at a dose of about 50 IU/kg at a dosing interval of at least about 6 to 10 days. In some embodiments, at least one of the multiple doses is administered at a dose of about 50 IU/kg at a dosing interval of at least about 6 to 8 days. In some embodiments, at least one of the multiple doses is administered at a dose of about 50 IU/kg at a dosing interval of at least about 6 to 9 days. In some embodiments, at least one of the multiple doses is administered at a dose of about 50 IU/kg at a dosing interval of at least about 6 to 11 days. In some embodiments, at least one of the multiple doses is administered at a dose of about 50 IU/kg at a dosing interval of at least about 6 to 12 days. In some embodiments, at least one of the multiple doses is administered at a dose of about 50 IU/kg at a dosing interval of at least about 6 to 13 days. In some embodiments, at least one of the multiple doses is administered at a dose of about 50 IU/kg at a dosing interval of at least about 7 to 9 days. In some embodiments, at least one of the multiple doses is administered at a dose of about 50 IU/kg at a dosing interval of at least about 7 to 10 days. In some embodiments, at least one of the multiple doses is administered at a dose of about 50 IU/kg at a dosing interval of at least about 7 to 11 days. In some embodiments, at least one of the multiple doses is administered at a dose of about 50 IU/kg at a dosing interval of at least about 7 to 12 days. In some embodiments, at least one of the multiple doses is administered at a dose of about 50 IU/kg at a dosing interval of at least about 7 to 13 days. In some embodiments, at least one of the multiple doses is administered at a dose of about 50 IU/kg at a dosing interval of at least about 7 to 14 days. In some embodiments, at least one of the multiple doses is administered at a dose of about 50 IU/kg at a dosing interval of at least about 8 to 14 days. In some embodiments, at least one of the multiple doses is administered at a dose of about 50 IU/kg at a dosing interval of at least about 9 to 14 days. In some embodiments, at least one of the multiple doses is administered at a dose of about 50 IU/kg at a dosing interval of at least about 10 to 14 days. In some embodiments, at least one of the multiple doses is administered at a dose of about 50 IU/kg at a dosing interval of at least about 10 to 21 days. In some embodiments, at least one of the multiple doses is administered at a dose of about 50 IU/kg at a dosing interval of at least about 11 to 14 days. In some embodiments, at least one of the multiple doses is administered at a dose of about 50 IU/kg at a dosing interval of at least about 12 to 14 days. In some embodiments, at least one of the multiple doses is administered at a dose of about 50 IU/kg at a dosing interval of at least about 12 to 15 days. In some embodiments, at least one of the multiple doses is administered at a dose of about 50 IU/kg at a dosing interval of at least about 13 to 15 days. In some embodiments, at least one of the multiple doses is administered at a dose of about 50 IU/kg at a dosing interval of at least about 14 to 21 days.

In some embodiments, such as for prophylactic treatment of hemophilia A, at least one of the multiple doses is administered at a dose of about 65 IU/kg at a dosing interval of at least about 5 to 14 days. In some embodiments, at least one of the multiple doses is administered at a dose of about 65 IU/kg at a dosing interval of at least about 6 to 14 days. In some embodiments, at least one of the multiple doses is administered at a dose of about 65 IU/kg at a dosing interval of at least about 6 to 10 days. In some embodiments, at least one of the multiple doses is administered at a dose of about 65 IU/kg at a dosing interval of at least about 6 to 8 days. In some embodiments, at least one of the multiple doses is administered at a dose of about 65 IU/kg at a dosing interval of at least about 6 to 9 days. In some embodiments, at least one of the multiple doses is administered at a dose of about 65 IU/kg at a dosing interval of at least about 6 to 11 days. In some embodiments, at least one of the multiple doses is administered at a dose of about 65 IU/kg at a dosing interval of at least about 6 to 12 days. In some embodiments, at least one of the multiple doses is administered at a dose of about 65 IU/kg at a dosing interval of at least about 6 to 13 days. In some embodiments, at least one of the multiple doses is administered at a dose of about 65 IU/kg at a dosing interval of at least about 7 to 9 days. In some embodiments, at least one of the multiple doses is administered at a dose of about 65 IU/kg at a dosing interval of at least about 7 to 10 days. In some embodiments, at least one of the multiple doses is administered at a dose of about 65 IU/kg at a dosing interval of at least about 7 to 11 days. In some embodiments, at least one of the multiple doses is administered at a dose of about 65 IU/kg at a dosing interval of at least about 7 to 12 days. In some embodiments, at least one of the multiple doses is administered at a dose of about 65 IU/kg at a dosing interval of at least about 7 to 13 days. In some embodiments, at least one of the multiple doses is administered at a dose of about 65 IU/kg at a dosing interval of at least about 7 to 14 days. In some embodiments, at least one of the multiple doses is administered at a dose of about 65 IU/kg at a dosing interval of at least about 8 to 14 days. In some embodiments, at least one of the multiple doses is administered at a dose of about 65 IU/kg at a dosing interval of at least about 9 to 14 days. In some embodiments, at least one of the multiple doses is administered at a dose of about 65 IU/kg at a dosing interval of at least about 10 to 14 days. In some embodiments, at least one of the multiple doses is administered at a dose of about 65 IU/kg at a dosing interval of at least about 10 to 21 days. In some embodiments, at least one of the multiple doses is administered at a dose of about 65 IU/kg at a dosing interval of at least about 11 to 14 days. In some embodiments, at least one of the multiple doses is administered at a dose of about 65 IU/kg at a dosing interval of at least about 12 to 14 days. In some embodiments, at least one of the multiple doses is administered at a dose of about 65 IU/kg at a dosing interval of at least about 12 to 15 days. In some embodiments, at least one of the multiple doses is administered at a dose of about 65 IU/kg at a dosing interval of at least about 13 to 15 days. In some embodiments, at least one of the multiple doses is administered at a dose of about 65 IU/kg at a dosing interval of at least about 14 to 21 days.

In some embodiments, such as for prophylactic treatment of hemophilia A, at least one of the multiple doses is administered at a dose of about 80 IU/kg at a dosing interval of at least about 5 to 14 days. In some embodiments, at least one of the multiple doses is administered at a dose of about 80 IU/kg at a dosing interval of at least about 6 to 14 days. In some embodiments, at least one of the multiple doses is administered at a dose of about 80 IU/kg at a dosing interval of at least about 6 to 10 days. In some embodiments, at least one of the multiple doses is administered at a dose of about 80 IU/kg at a dosing interval of at least about 6 to 8 days. In some embodiments, at least one of the multiple doses is administered at a dose of about 80 IU/kg at a dosing interval of at least about 6 to 9 days. In some embodiments, at least one of the multiple doses is administered at a dose of about 80 IU/kg at a dosing interval of at least about 6 to 11 days. In some embodiments, at least one of the multiple doses is administered at a dose of about 80 IU/kg at a dosing interval of at least about 6 to 12 days. In some embodiments, at least one of the multiple doses is administered at a dose of about 80 IU/kg at a dosing interval of at least about 6 to 13 days. In some embodiments, at least one of the multiple doses is administered at a dose of about 80 IU/kg at a dosing interval of at least about 7 to 9 days. In some embodiments, at least one of the multiple doses is administered at a dose of about 80 IU/kg at a dosing interval of at least about 7 to 10 days. In some embodiments, at least one of the multiple doses is administered at a dose of about 80 IU/kg at a dosing interval of at least about 7 to 11 days. In some embodiments, at least one of the multiple doses is administered at a dose of about 80 IU/kg at a dosing interval of at least about 7 to 12 days. In some embodiments, at least one of the multiple doses is administered at a dose of about 80 IU/kg at a dosing interval of at least about 7 to 13 days. In some embodiments, at least one of the multiple doses is administered at a dose of about 80 IU/kg at a dosing interval of at least about 7 to 14 days. In some embodiments, at least one of the multiple doses is administered at a dose of about 80 IU/kg at a dosing interval of at least about 8 to 14 days. In some embodiments, at least one of the multiple doses is administered at a dose of about 80 IU/kg at a dosing interval of at least about 9 to 14 days. In some embodiments, at least one of the multiple doses is administered at a dose of about 80 IU/kg at a dosing interval of at least about 10 to 14 days. In some embodiments, at least one of the multiple doses is administered at a dose of about 80 IU/kg at a dosing interval of at least about 10 to 21 days. In some embodiments, at least one of the multiple doses is administered at a dose of about 80 IU/kg at a dosing interval of at least about 11 to 14 days. In some embodiments, at least one of the multiple doses is administered at a dose of about 80 IU/kg at a dosing interval of at least about 12 to 14 days. In some embodiments, at least one of the multiple doses is administered at a dose of about 80 IU/kg at a dosing interval of at least about 12 to 15 days. In some embodiments, at least one of the multiple doses is administered at a dose of about 80 IU/kg at a dosing interval of at least about 13 to 15 days. In some embodiments, at least one of the multiple doses is administered at a dose of about 80 IU/kg at a dosing interval of at least about 14 to 21 days.

In some embodiments, such as for prophylactic treatment of hemophilia A, at least one of the multiple doses is administered at a dose of about 50 IU/kg to about 80 IU/kg at a dosing interval of at least about 5 to 14 days. In some embodiments, at least one of the multiple doses is administered at a dose of about 50 IU/kg to about 80 IU/kg at a dosing interval of at least about 6 to 14 days. In some embodiments, at least one of the multiple doses is administered at a dose of about 50 IU/kg to about 80 IU/kg at a dosing interval of at least about 6 to 10 days. In some embodiments, at least one of the multiple doses is administered at a dose of about 50 IU/kg to about 80 IU/kg at a dosing interval of at least about 6 to 8 days. In some embodiments, at least one of the multiple doses is administered at a dose of about 50 IU/kg to about 80 IU/kg at a dosing interval of at least about 6 to 9 days. In some embodiments, at least one of the multiple doses is administered at a dose of about 50 IU/kg to about 80 IU/kg at a dosing interval of at least about 6 to 11 days. In some embodiments, at least one of the multiple doses is administered at a dose of about 50 IU/kg to about 80 IU/kg at a dosing interval of at least about 6 to 12 days. In some embodiments, at least one of the multiple doses is administered at a dose of about 50 IU/kg to about 80 IU/kg at a dosing interval of at least about 6 to 13 days. In some embodiments, at least one of the multiple doses is administered at a dose of about 50 IU/kg to about 80 IU/kg at a dosing interval of at least about 7 to 9 days. In some embodiments, at least one of the multiple doses is administered at a dose of about 50 IU/kg to about 80 IU/kg at a dosing interval of at least about 7 to 10 days. In some embodiments, at least one of the multiple doses is administered at a dose of about 50 IU/kg to about 80 IU/kg at a dosing interval of at least about 7 to 11 days. In some embodiments, at least one of the multiple doses is administered at a dose of about 50 IU/kg to about 80 IU/kg at a dosing interval of at least about 7 to 12 days. In some embodiments, at least one of the multiple doses is administered at a dose of about 50 IU/kg to about 80 IU/kg at a dosing interval of at least about 7 to 13 days. In some embodiments, at least one of the multiple doses is administered at a dose of about 50 IU/kg to about 80 IU/kg at a dosing interval of at least about 7 to 14 days. In some embodiments, at least one of the multiple doses is administered at a dose of about 50 IU/kg to about 80 IU/kg at a dosing interval of at least about 8 to 14 days. In some embodiments, at least one of the multiple doses is administered at a dose of about 50 IU/kg to about 80 IU/kg at a dosing interval of at least about 9 to 14 days. In some embodiments, at least one of the multiple doses is administered at a dose of about 50 IU/kg to about 80 IU/kg at a dosing interval of at least about 10 to 14 days. In some embodiments, at least one of the multiple doses is administered at a dose of about 50 IU/kg to about 80 IU/kg at a dosing interval of at least about 10 to 21 days. In some embodiments, at least one of the multiple doses is administered at a dose of about 50 IU/kg to about 80 IU/kg at a dosing interval of at least about 11 to 14 days. In some embodiments, at least one of the multiple doses is administered at a dose of about 50 IU/kg to about 80 IU/kg at a dosing interval of at least about 12 to 14 days. In some embodiments, at least one of the multiple doses is administered at a dose of about 50 IU/kg to about 80 IU/kg at a dosing interval of at least about 12 to 15 days. In some embodiments, at least one of the multiple doses is administered at a dose of about 50 IU/kg to about 80 IU/kg at a dosing interval of at least about 13 to 15 days. In some embodiments, at least one of the multiple doses is administered at a dose of about 50 IU/kg to about 80 IU/kg at a dosing interval of at least about 14 to 21 days.

In some embodiments, such as for prophylactic treatment of hemophilia A, at least one of the multiple doses is administered at a dose of about 50 IU/kg to about 65 IU/kg at a dosing interval of at least about 5 to 14 days. In some embodiments, at least one of the multiple doses is administered at a dose of about 50 IU/kg to about 65 IU/kg at a dosing interval of at least about 6 to 14 days. In some embodiments, at least one of the multiple doses is administered at a dose of about 50 IU/kg to about 65 IU/kg at a dosing interval of at least about 6 to 10 days. In some embodiments, at least one of the multiple doses is administered at a dose of about 50 IU/kg to about 65 IU/kg at a dosing interval of at least about 6 to 8 days. In some embodiments, at least one of the multiple doses is administered at a dose of about 50 IU/kg to about 65 IU/kg at a dosing interval of at least about 6 to 9 days. In some embodiments, at least one of the multiple doses is administered at a dose of about 50 IU/kg to about 65 IU/kg at a dosing interval of at least about 6 to 11 days. In some embodiments, at least one of the multiple doses is administered at a dose of about 50 IU/kg to about 65 IU/kg at a dosing interval of at least about 6 to 12 days. In some embodiments, at least one of the multiple doses is administered at a dose of about 50 IU/kg to about 65 IU/kg at a dosing interval of at least about 6 to 13 days. In some embodiments, at least one of the multiple doses is administered at a dose of about 50 IU/kg to about 65 IU/kg at a dosing interval of at least about 7 to 9 days. In some embodiments, at least one of the multiple doses is administered at a dose of about 50 IU/kg to about 65 IU/kg at a dosing interval of at least about 7 to 10 days. In some embodiments, at least one of the multiple doses is administered at a dose of about 50 IU/kg to about 65 IU/kg at a dosing interval of at least about 7 to 11 days. In some embodiments, at least one of the multiple doses is administered at a dose of about 50 IU/kg to about 65 IU/kg at a dosing interval of at least about 7 to 12 days. In some embodiments, at least one of the multiple doses is administered at a dose of about 50 IU/kg to about 65 IU/kg at a dosing interval of at least about 7 to 13 days. In some embodiments, at least one of the multiple doses is administered at a dose of about 50 IU/kg to about 65 IU/kg at a dosing interval of at least about 7 to 14 days. In some embodiments, at least one of the multiple doses is administered at a dose of about 50 IU/kg to about 65 IU/kg at a dosing interval of at least about 8 to 14 days. In some embodiments, at least one of the multiple doses is administered at a dose of about 50 IU/kg to about 65 IU/kg at a dosing interval of at least about 9 to 14 days. In some embodiments, at least one of the multiple doses is administered at a dose of about 50 IU/kg to about 65 IU/kg at a dosing interval of at least about 10 to 14 days. In some embodiments, at least one of the multiple doses is administered at a dose of about 50 IU/kg to about 65 IU/kg at a dosing interval of at least about 10 to 21 days. In some embodiments, at least one of the multiple doses is administered at a dose of about 50 IU/kg to about 65 IU/kg at a dosing interval of at least about 11 to 14 days. In some embodiments, at least one of the multiple doses is administered at a dose of about 50 IU/kg to about 65 IU/kg at a dosing interval of at least about 12 to 14 days. In some embodiments, at least one of the multiple doses is administered at a dose of about 50 IU/kg to about 65 IU/kg at a dosing interval of at least about 12 to 15 days. In some embodiments, at least one of the multiple doses is administered at a dose of about 50 IU/kg to about 65 IU/kg at a dosing interval of at least about 13 to 15 days. In some embodiments, at least one of the multiple doses is administered at a dose of about 50 IU/kg to about 65 IU/kg at a dosing interval of at least about 14 to 21 days.

In some embodiments, such as for prophylactic treatment of hemophilia A, at least one of the multiple doses is administered at a dose of about 65 IU/kg to about 80 IU/kg at a dosing interval of at least about 5 to 14 days. In some embodiments, at least one of the multiple doses is administered at a dose of about 65 IU/kg to about 80 IU/kg at a dosing interval of at least about 6 to 14 days. In some embodiments, at least one of the multiple doses is administered at a dose of about 65 IU/kg to about 80 IU/kg at a dosing interval of at least about 6 to 10 days. In some embodiments, at least one of the multiple doses is administered at a dose of about 65 IU/kg to about 80 IU/kg at a dosing interval of at least about 6 to 8 days. In some embodiments, at least one of the multiple doses is administered at a dose of about 65 IU/kg to about 80 IU/kg at a dosing interval of at least about 6 to 9 days. In some embodiments, at least one of the multiple doses is administered at a dose of about 65 IU/kg to about 80 IU/kg at a dosing interval of at least about 6 to 11 days. In some embodiments, at least one of the multiple doses is administered at a dose of about 65 IU/kg to about 80 IU/kg at a dosing interval of at least about 6 to 12 days. In some embodiments, at least one of the multiple doses is administered at a dose of about 65 IU/kg to about 80 IU/kg at a dosing interval of at least about 6 to 13 days. In some embodiments, at least one of the multiple doses is administered at a dose of about 65 IU/kg to about 80 IU/kg at a dosing interval of at least about 7 to 9 days. In some embodiments, at least one of the multiple doses is administered at a dose of about 65 IU/kg to about 80 IU/kg at a dosing interval of at least about 7 to 10 days. In some embodiments, at least one of the multiple doses is administered at a dose of about 65 IU/kg to about 80 IU/kg at a dosing interval of at least about 7 to 11 days. In some embodiments, at least one of the multiple doses is administered at a dose of about 65 IU/kg to about 80 IU/kg at a dosing interval of at least about 7 to 12 days. In some embodiments, at least one of the multiple doses is administered at a dose of about 65 IU/kg to about 80 IU/kg at a dosing interval of at least about 7 to 13 days. In some embodiments, at least one of the multiple doses is administered at a dose of about 65 IU/kg to about 80 IU/kg at a dosing interval of at least about 7 to 14 days. In some embodiments, at least one of the multiple doses is administered at a dose of about 65 IU/kg to about 80 IU/kg at a dosing interval of at least about 8 to 14 days. In some embodiments, at least one of the multiple doses is administered at a dose of about 65 IU/kg to about 80 IU/kg at a dosing interval of at least about 9 to 14 days. In some embodiments, at least one of the multiple doses is administered at a dose of about 65 IU/kg to about 80 IU/kg at a dosing interval of at least about 10 to 14 days. In some embodiments, at least one of the multiple doses is administered at a dose of about 65 IU/kg to about 80 IU/kg at a dosing interval of at least about 10 to 21 days. In some embodiments, at least one of the multiple doses is administered at a dose of about 65 IU/kg to about 80 IU/kg at a dosing interval of at least about 11 to 14 days. In some embodiments, at least one of the multiple doses is administered at a dose of about 65 IU/kg to about 80 IU/kg at a dosing interval of at least about 12 to 14 days. In some embodiments, at least one of the multiple doses is administered at a dose of about 65 IU/kg to about 80 IU/kg at a dosing interval of at least about 12 to 15 days. In some embodiments, at least one of the multiple doses is administered at a dose of about 65 IU/kg to about 80 IU/kg at a dosing interval of at least about 13 to 15 days. In some embodiments, at least one of the multiple doses is administered at a dose of about 65 IU/kg to about 80 IU/kg at a dosing interval of at least about 14 to 21 days.

In some embodiments, such as for prophylactic treatment of hemophilia A in a pediatric subject, at least one of the multiple doses is administered at a dose of about 65 IU/kg to about 80 IU/kg at a dosing interval of at least about 2 to 14 days. In some embodiments, at least one of the multiple doses is administered at a dose of about 65 IU/kg to about 80 IU/kg at a dosing interval of at least about 2 to 10 days.

In some embodiments, at least one of the multiple doses is administered at a dose of about 65 IU/kg to about 80 IU/kg at a dosing interval of at least about 2 to 8 days. In some embodiments, at least one of the multiple doses is administered at a dose of about 65 IU/kg to about 80 IU/kg at a dosing interval of at least about 2 to 9 days. In some embodiments, at least one of the multiple doses is administered at a dose of about 65 IU/kg to about 80 IU/kg at a dosing interval of at least about 2 to 11 days. In some embodiments, at least one of the multiple doses is administered at a dose of about 65 IU/kg to about 80 IU/kg at a dosing interval of at least about 2 to 12 days. In some embodiments, at least one of the multiple doses is administered at a dose of about 65 IU/kg to about 80 IU/kg at a dosing interval of at least about 2 to 13 days. In some embodiments, at least one of the multiple doses is administered at a dose of about 65 IU/kg to about 80 IU/kg at a dosing interval of at least about 4 to 9 days. In some embodiments, at least one of the multiple doses is administered at a dose of about 65 IU/kg to about 80 IU/kg at a dosing interval of at least about 4 to 10 days. In some embodiments, at least one of the multiple doses is administered at a dose of about 65 IU/kg to about 80 IU/kg at a dosing interval of at least about 4 to 11 days. In some embodiments, at least one of the multiple doses is administered at a dose of about 65 IU/kg to about 80 IU/kg at a dosing interval of at least about 4 to 12 days. In some embodiments, at least one of the multiple doses is administered at a dose of about 65 IU/kg to about 80 IU/kg at a dosing interval of at least about 4 to 13 days. In some embodiments, at least one of the multiple doses is administered at a dose of about 65 IU/kg to about 80 IU/kg at a dosing interval of at least about 4 to 14 days. In some embodiments, at least one of the multiple doses is administered at a dose of about 65 IU/kg to about 80 IU/kg at a dosing interval of at least about 5 to 14 days. In some embodiments, at least one of the multiple doses is administered at a dose of about 65 IU/kg to about 80 IU/kg at a dosing interval of at least about 5 to 14 days. In some embodiments, at least one of the multiple doses is administered at a dose of about 65 IU/kg to about 80 IU/kg at a dosing interval of at least about 6 to 14 days. In some embodiments, at least one of the multiple doses is administered at a dose of about 65 IU/kg to about 80 IU/kg at a dosing interval of at least about 7 to 14 days. In some embodiments, at least one of the multiple doses is administered at a dose of about 65 IU/kg to about 80 IU/kg at a dosing interval of at least about 8 to 14 days. In some embodiments, at least one of the multiple doses is administered at a dose of about 65 IU/kg to about 80 IU/kg at a dosing interval of at least about 10 to 15 days. In some embodiments, at least one of the multiple doses is administered at a dose of about 65 IU/kg to about 80 IU/kg at a dosing interval of at least about 10 to 21 days. In some embodiments, at least one of the multiple doses is administered at a dose of about 65 IU/kg to about 80 IU/kg at a dosing interval of at least about 13 to 15 days. In some embodiments, at least one of the multiple doses is administered at a dose of about 65 IU/kg to about 80 IU/kg at a dosing interval of at least about 14 to 21 days.

In some embodiments, such as for prophylactic treatment of hemophilia A in a pediatric subject, at least one of the multiple doses is administered at a dose of about 65 IU/kg to about 80 IU/kg at a dosing interval of at least about 5 days. In some embodiments, such as for prophylactic treatment of hemophilia A in a pediatric subject, at least one of the multiple doses is administered at a dose of about 65

IU/kg to about 80 IU/kg at a dosing interval of at least about 7 days. In some embodiments, such as for prophylactic treatment of hemophilia A in a pediatric subject, at least one of the multiple doses is administered at a dose of about 65 IU/kg to about 80 IU/kg at a dosing interval of at least about 6 days. In some embodiments, such as for prophylactic treatment of hemophilia A in a pediatric subject, at least one of the multiple doses is administered at a dose of about 65 IU/kg to about 80 IU/kg at a dosing interval of at least about 5 days. In some embodiments, such as for prophylactic treatment of hemophilia A in a pediatric subject, at least one of the multiple doses is administered at a dose of about 65 IU/kg to about 80 IU/kg at a dosing interval of at least about 4 days. In some embodiments, such as for prophylactic treatment of hemophilia A in a pediatric subject, at least one of the multiple doses is administered at a dose of about 65 IU/kg to about 80 IU/kg at a dosing interval of at least about 3 days. In some embodiments, such as for prophylactic treatment of hemophilia A in a pediatric subject, at least one of the multiple doses is administered at a dose of about 65 IU/kg to about 80 IU/kg at a dosing interval of at least about 2 days. In some embodiments, such as for prophylactic treatment of hemophilia A in a pediatric subject, at least one of the multiple doses is administered at a dose of about 65 IU/kg to about 80 IU/kg at a dosing interval of at least about 8 days. In some embodiments, such as for prophylactic treatment of hemophilia A in a pediatric subject, at least one of the multiple doses is administered at a dose of about 65 IU/kg to about 80 IU/kg at a dosing interval of at least about 9 days. In some embodiments, such as for prophylactic treatment of hemophilia A in a pediatric subject, at least one of the multiple doses is administered at a dose of about 65 IU/kg to about 80 IU/kg at a dosing interval of at least about 10 days. In some embodiments, such as for prophylactic treatment of hemophilia A in a pediatric subject, at least one of the multiple doses is administered at a dose of about 65 IU/kg to about 80 IU/kg at a dosing interval of at least about 11 days. In some embodiments, such as for prophylactic treatment of hemophilia A in a pediatric subject, at least one of the multiple doses is administered at a dose of about 65 IU/kg to about 80 IU/kg at a dosing interval of at least about 12 days. In some embodiments, such as for prophylactic treatment of hemophilia A in a pediatric subject, at least one of the multiple doses is administered at a dose of about 65 IU/kg to about 80 IU/kg at a dosing interval of at least about 13 days. In some embodiments, such as for prophylactic treatment of hemophilia A in a pediatric subject, at least one of the multiple doses is administered at a dose of about 65 IU/kg to about 80 IU/kg at a dosing interval of at least about 14 days. In some embodiments, such as for prophylactic treatment of hemophilia A in a pediatric subject, at least one of the multiple doses is administered at a dose of about 65 IU/kg to about 80 IU/kg at a dosing interval of at least about 21 days.

In some embodiments, such as for prophylactic treatment of hemophilia A in a pediatric subject, at least one of the multiple doses is administered at a dose of about 65 IU/kg to about 80 IU/kg at a dosing interval of at least about 1 week. In some embodiments, such as for prophylactic treatment of hemophilia A in a pediatric subject, at least one of the multiple doses is administered at a dose of about 65 IU/kg to about 80 IU/kg at a dosing frequency of at least twice about every 1 week.

In certain embodiments, such as for prophylactic treatment of hemophilia A, the method comprises administering to the subject multiple doses of a chimeric polypeptide comprising (i) a FVIII protein and (ii) a VWF fragment comprising a D' domain of VWF and a D3 domain of VWF, e.g., rFVIIIFc-VWF-XTEN, at a dosing interval, wherein at least one of the multiple doses is from about 15 IU/kg to about 100 IU/kg and the dosing interval is at least about 5 days. In certain embodiments, such as for prophylactic treatment of hemophilia A, the method comprises administering to the subject multiple doses of a chimeric polypeptide comprising (i) a FVIII protein and (ii) a VWF fragment comprising a D' domain of VWF and a D3 domain of VWF at a dosing interval, wherein at least one of the multiple doses is from about 15 IU/kg to about 100 IU/kg and the dosing interval is at least about 7 days. In certain embodiments, at least one of the multiple doses is from about 25 IU/kg to about 65 IU/kg and the dosing interval is at least about 8 days. In certain embodiments, at least one of the multiple doses is from about 25 IU/kg to about 65 IU/kg and the dosing interval is at least about 9 days. In certain embodiments, at least one of the multiple doses is from about 25 IU/kg to about 65 IU/kg and the dosing interval is at least about 10 days. In certain embodiments, at least one of the multiple doses is from about 25 IU/kg to about 65 IU/kg and the dosing interval is at least about 11 days. In certain embodiments, at least one of the multiple doses is from about 25 IU/kg to about 65 IU/kg and the dosing interval is at least about 12 days. In certain embodiments, at least one of the multiple doses is from about 25 IU/kg to about 65 IU/kg and the dosing interval is at least about 13 days. In certain embodiments, at least one of the multiple doses is from about 25 IU/kg to about 65 IU/kg and the dosing interval is at least about 14 days. In certain embodiments, at least one of the multiple doses is from about 25 IU/kg to about 65 IU/kg and the dosing interval is at least about 15 days. In certain embodiments, at least one of the multiple doses is from about 25 IU/kg to about 65 IU/kg and the dosing interval is at least about 16 days. In certain embodiments, at least one of the multiple doses is from about 25 IU/kg to about 65 IU/kg and the dosing interval is at least about 17 days. In certain embodiments, at least one of the multiple doses is from about 25 IU/kg to about 65 IU/kg and the dosing interval is at least about 18 days. In certain embodiments, at least one of the multiple doses is from about 25 IU/kg to about 65 IU/kg and the dosing interval is at least about 19 days. In certain embodiments, at least one of the multiple doses is from about 25 IU/kg to about 65 IU/kg and the dosing interval is at least about 20 days. In certain embodiments, at least one of the multiple doses is from about 25 IU/kg to about 65 IU/kg and the dosing interval is at least about 21 days.

In certain embodiments, the method comprises administering to the subject multiple doses of a chimeric polypeptide comprising (i) a FVIII protein and (ii) a VWF fragment comprising a D' domain of VWF and a D3 domain of VWF, e.g., rFVIIIFc-VWF-XTEN, at a dosing interval, wherein at least one of the multiple doses is about 25 IU/kg and the dosing interval is at least about 5 days. In certain embodiments, the method comprises administering to the subject multiple doses of a chimeric polypeptide comprising (i) a FVIII protein and (ii) a VWF fragment comprising a D' domain of VWF and a D3 domain of VWF at a dosing interval, wherein at least one of the multiple doses is about 25 IU/kg and the dosing interval is at least about 6 days. In some embodiments, the method is for the prophylactic treatment of hemophilia A. In certain embodiments, at least one of the multiple doses is about 25 IU/kg and the dosing interval is at least about 7 days. In certain embodiments, at least one of the multiple doses is about 25 IU/kg and the dosing interval is at least about 8 days. In certain embodiments, at least one of the multiple doses is about 25 IU/kg and the dosing interval is at least about 9 days. In certain embodiments, at least one of the multiple doses is about 25 IU/kg and the dosing interval is at least about 10 days. In certain embodiments, at least one of the multiple doses is about 25 IU/kg and the dosing interval is at least about 11 days. In certain embodiments, at least one of the multiple doses is about 25 IU/kg and the dosing interval is at least about 12 days. In certain embodiments, at least one of the multiple doses is about 25 IU/kg and the dosing interval is at least about 13 days. In certain embodiments, at least one of the multiple doses is about 25 IU/kg and the dosing interval is at least about 14 days. In certain embodiments, at least one of the multiple doses is from about 25 IU/kg and the dosing interval is at least about 15 days. In certain embodiments, at least one of the multiple doses is from about 25 IU/kg and the dosing interval is at least about 16 days. In certain embodiments, at least one of the multiple doses is from about 25 IU/kg and the dosing interval is at least about 17 days. In certain embodiments, at least one of the multiple doses is from about 25 IU/kg and the dosing interval is at least about 18 days. In certain embodiments, at least one of the multiple doses is from about 25 IU/kg and the dosing interval is at least about 19 days. In certain embodiments, at least one of the multiple doses is from about 25 IU/kg and the dosing interval is at least about 20 days. In certain embodiments, at least one of the multiple doses is from about 25 IU/kg and the dosing interval is at least about 21 days.

In certain embodiments, the method comprises administering to the subject multiple doses of a chimeric polypeptide comprising (i) a FVIII protein and (ii) a VWF fragment comprising a D' domain of VWF and a D3 domain of VWF, e.g., rFVIIIFc-VWF-XTEN, at a dosing interval, wherein at least one of the multiple doses is about 50 IU/kg and the dosing interval is at least about 5 days. In certain embodiments, the method comprises administering to the subject multiple doses of a chimeric polypeptide comprising (i) a FVIII protein and (ii) a VWF fragment comprising a D' domain of VWF and a D3 domain of VWF at a dosing interval, wherein at least one of the multiple doses is about 50 IU/kg and the dosing interval is at least about 6 days. In some embodiments, the method is for the prophylactic treatment of hemophilia A. In certain embodiments, at least one of the multiple doses is about 50 IU/kg and the dosing interval is at least about 7 days. In certain embodiments, at least one of the multiple doses is about 50 IU/kg and the dosing interval is at least about 8 days. In certain embodiments, at least one of the multiple doses is about 50 IU/kg and the dosing interval is at least about 9 days. In certain embodiments, at least one of the multiple doses is about 50 IU/kg and the dosing interval is at least about 10 days. In certain embodiments, at least one of the multiple doses is about 50 IU/kg and the dosing interval is at least about 11 days. In certain embodiments, at least one of the multiple doses is about 50 IU/kg and the dosing interval is at least about 12 days. In certain embodiments, at least one of the multiple doses is about 50 IU/kg and the dosing interval is at least about 13 days. In certain embodiments, at least one of the multiple doses is about 50 IU/kg and the dosing interval is at least about 14 days. In certain embodiments, at least one of the multiple doses is from about 50 IU/kg and the dosing interval is at least about 15 days. In certain embodiments, at least one of the multiple doses is from about 50 IU/kg and the dosing interval is at least about 16 days. In certain embodiments, at least one of the multiple doses is from about 50 IU/kg and the dosing interval is at least about 17 days. In certain embodiments, at least one of the multiple doses is from about 50 IU/kg and the dosing interval is at least about 18 days. In certain embodiments, at least one of the multiple doses is from about 50 IU/kg and the dosing interval is at least about 19 days. In certain embodiments, at least one of the multiple doses is from about 50 IU/kg and the dosing interval is at least about 20 days. In certain embodiments, at least one of the multiple doses is from about 50 IU/kg and the dosing interval is at least about 21 days.

In certain embodiments, the method comprises administering to the subject multiple doses of a chimeric polypeptide comprising (i) a FVIII protein and (ii) a VWF fragment comprising a D' domain of VWF and a D3 domain of VWF, e.g., rFVIIIFc-VWF-XTEN, at a dosing interval, wherein at least one of the multiple doses is about 65 IU/kg and the dosing interval is at least about 5 days. In certain embodiments, the method comprises administering to the subject multiple doses of a chimeric polypeptide comprising (i) a FVIII protein and (ii) a VWF fragment comprising a D' domain of VWF and a D3 domain of VWF at a dosing interval, wherein at least one of the multiple doses is about 65 IU/kg and the dosing interval is at least about 6 days. In some embodiments, the method is for the prophylactic treatment of hemophilia A. In certain embodiments, at least one of the multiple doses is about 65 IU/kg and the dosing interval is at least about 7 days. In certain embodiments, at least one of the multiple doses is about 65 IU/kg and the dosing interval is at least about 8 days. In certain embodiments, at least one of the multiple doses is about 65 IU/kg and the dosing interval is at least about 9 days. In certain embodiments, at least one of the multiple doses is about 65 IU/kg and the dosing interval is at least about 10 days. In certain embodiments, at least one of the multiple doses is about 65 IU/kg and the dosing interval is at least about 11 days. In certain embodiments, at least one of the multiple doses is about 65 IU/kg and the dosing interval is at least about 12 days. In certain embodiments, at least one of the multiple doses is about 65 IU/kg and the dosing interval is at least about 13 days. In certain embodiments, at least one of the multiple doses is about 65 IU/kg and the dosing interval is at least about 14 days. In certain embodiments, at least one of the multiple doses is from about 65 IU/kg and the dosing interval is at least about 15 days. In certain embodiments, at least one of the multiple doses is from about 65 IU/kg and the dosing interval is at least about 16 days. In certain embodiments, at least one of the multiple doses is from about 65 IU/kg and the dosing interval is at least about 17 days. In certain embodiments, at least one of the multiple doses is from about 65 IU/kg and the dosing interval is at least about 18 days. In certain embodiments, at least one of the multiple doses is from about 65 IU/kg and the dosing interval is at least about 19 days. In certain embodiments, at least one of the multiple doses is from about 65 IU/kg and the dosing interval is at least about 20 days. In certain embodiments, at least one of the multiple doses is from about 65 IU/kg and the dosing interval is at least about 21 days.

In certain embodiments, the method comprises administering to the subject multiple doses of a chimeric polypeptide comprising (i) a FVIII protein and (ii) a VWF fragment comprising a D' domain of VWF and a D3 domain of VWF, e.g., rFVIIIFc-VWF-XTEN, at a dosing interval, wherein at least one of the multiple doses is about 80 IU/kg and the dosing interval is at least about 5 days. In certain embodiments, the method comprises administering to the subject multiple doses of a chimeric polypeptide comprising (i) a FVIII protein and (ii) a VWF fragment comprising a D' domain of VWF and a D3 domain of VWF at a dosing interval, wherein at least one of the multiple doses is about 80 IU/kg and the dosing interval is at least about 6 days. In some embodiments, the method is for the prophylactic treatment of hemophilia A. In certain embodiments, at least one of the multiple doses is about 80 IU/kg and the dosing interval is at least about 7 days. In certain embodiments, at least one of the multiple doses is about 80 IU/kg and the dosing interval is at least about 8 days. In certain embodiments, at least one of the multiple doses is about 80 IU/kg and the dosing interval is at least about 9 days. In certain embodiments, at least one of the multiple doses is about 80 IU/kg and the dosing interval is at least about 10 days. In certain embodiments, at least one of the multiple doses is about 80 IU/kg and the dosing interval is at least about 11 days. In certain embodiments, at least one of the multiple doses is about 80 IU/kg and the dosing interval is at least about 12 days. In certain embodiments, at least one of the multiple doses is about 80 IU/kg and the dosing interval is at least about 13 days. In certain embodiments, at least one of the multiple doses is about 80 IU/kg and the dosing interval is at least about 14 days. In certain embodiments, at least one of the multiple doses is from about 80 IU/kg and the dosing interval is at least about 15 days. In certain embodiments, at least one of the multiple doses is from about 80 IU/kg and the dosing interval is at least about 16 days. In certain embodiments, at least one of the multiple doses is from about 80 IU/kg and the dosing interval is at least about 17 days. In certain embodiments, at least one of the multiple doses is from about 80 IU/kg and the dosing interval is at least about 18 days. In certain embodiments, at least one of the multiple doses is from about 80 IU/kg and the dosing interval is at least about 19 days. In certain embodiments, at least one of the multiple doses is from about 80 IU/kg and the dosing interval is at least about 20 days. In certain embodiments, at least one of the multiple doses is from about 80 IU/kg and the dosing interval is at least about 21 days.

In some embodiments, the chimeric polypeptide is administered for prophylactic treatment of hemophilia A. Prophylactic treatment of hemophilia A includes alleviating or reducing the severity of the symptoms of hemophilia A on a continuous or nearly continuous basis. In some embodiments, the prophylactic treatment is administered before the occurrence of a symptom of hemophilia A, e.g., before a bleeding incident. In other embodiments, the prophylactic treatment is administered on a regular basis, e.g., at a dosing interval described herein, to prevent the onset of or to lessen the severity of a symptom prior to the onset of the symptom. Any dosing interval disclosed herein can be used in a prophylactic treatment of hemophilia A.

In other embodiments, the chimeric polypeptide is administered before an activity that can bring on one or more symptom of hemophilia A, e.g., as an on-demand treatment. For example, a chimeric polypeptide of the present disclosure can be administered to a subject suffering from hemophilia A before the subject undergoes a surgery or engages in an activity that otherwise increases the risk of physical trauma and/or a bleeding incident. When administered on-demand, the chimeric polypeptide can be administered as a single dose or as multiple doses. In some embodiments, the on-demand treatment comprises administering multiple doses of the chimeric polypeptide at a dosing interval of at least about 12 hours, at least about 24 hours, at least about 36 hours, at least about 48 hours, at least about 60 hours, at least about 72 hours, at least about 84 hours, at least about 96 hours, at least about 108 hours or at least about 120 hours. In certain embodiments, the on-demand treatment comprises administering at least 2 doses, at least 3 doses, at least 4 doses or at least 5 doses of the chimeric polypeptide.

In some embodiments, the subject has previously been treated with one or more FVIII replacement therapy. In certain embodiments, the subject failed to respond to a previous FVIII replacement therapy. In certain embodiments, the FVIII replacement therapy is ELOCTATE® or ADVATE®. In some embodiments, the subject is an adult. In some embodiments, the subject is an adult male. In other embodiments, the subject is an adult female. In other embodiments, the subject is a child, e.g., less than or equal to about 12 years old, less than or equal to or equal to about 11 years old, less than or equal to about 10 years old, less than or equal to about 9 years old, less than or equal to about 8 years old, less than or equal to about 7 years old, less than or equal to about 6 years old, less than or equal to about 5 years old, less than or equal to about 4 years old, less than or equal to about 3 years old, less than or equal to about 2 years old, or less than or equal to about 1 year old). In some embodiments, the subject is a female. In some embodiments, the subject is a male. In some embodiments, the subject is a female less than or equal to about 12 years old. In some embodiments, the subject is a female less than or equal to about 11 years old. In some embodiments, the subject is a female less than or equal to about 10 years old.

A chimeric polypeptide described herein can be administered by any means known in the art. In some embodiments, the chimeric polypeptide is administered by a route selected from the group consisting of intravenous injection, intravenous infusion, subcutaneous administration, intramuscular administration, oral administration, nasal administration, and pulmonary administration. In some embodiments, the chimeric polypeptide is administered intravenously. In other embodiments, the chimeric polypeptide is administered subcutaneously.

In some embodiments, the chimeric polypeptide, e.g., rFVIIIFc-VWF-XTEN, after the administration results in a FVIII plasma activity level of at least about 1%, at least about 2%, at least about 3%, at least about 4%, at least about 5%, at least about 6%, at least about 7%, at least about 8%, at least about 9%, or at least about 10%. In certain embodiments, the FVIII plasma activity level is at least about 3%. In some embodiments, the FVIII plasma activity level is at least about 4%. In some embodiments, the FVIII plasma activity level is at least about 5%. In some embodiments, the FVIII plasma activity level is at least about 4%. In some embodiments, the FVIII plasma activity level is at least about 5%. In some embodiments, the FVIII plasma activity level is at least about 5.6%. In some embodiments, the FVIII plasma activity level is at least about 7%. In some embodiments, the FVIII plasma activity level is at least about 10%. In some embodiments, the FVIII plasma activity level is at least about 12%. In some embodiments, the FVIII plasma activity level is at least about 12.95%. As used herein, plasma activity level is expressed as a percent (%). Alternatively, plasma activity can be expressed in IU/dL units, wherein 1% is equal to 1 IU/dL In some embodiments, the FVIII plasma activity level is at least about 10% at least about 5 days after the administration of the chimeric polypeptide, e.g., at a dose of 25 IU/kg. In some embodiments, the FVIII plasma activity level is at least about 12% at least about 5 days after the administration of the chimeric polypeptide, e.g., at a dose of 25 IU/kg. In some embodiments, the FVIII plasma activity level is at least about 12.95% at least about 5 days after the administration of the chimeric polypeptide, e.g., at a dose of 25 IU/kg. In some embodiments, the FVIII plasma activity level is at least about 5% at least about 7 days after the administration of the chimeric polypeptide, e.g., at a dose of 25 IU/kg. In some embodiments, the FVIII plasma activity level is at least about 5.6% at least about 7 days after the administration of the chimeric polypeptide, e.g., at a dose of 25 IU/kg. In some embodiments, the FVIII plasma activity level is at least about 3% at least about 8 days after the administration of the chimeric polypeptide, e.g., ata dose of 25 IU/kg. In some embodiments, the FVIII plasma activity level is at least about 1% at least about 10 days after the administration of the chimeric polypeptide, e.g., at a dose of 25 IU/kg.

The present disclosure also includes a method of treating hemophilia A comprising administering to a subject a composition comprising (i) a FVIII protein and (ii) a VWF fragment. In some embodiments, the FVIII protein is present in a first formulation and the VWF fragment is present in a second formulation. In other embodiments, the FVIII protein and the VWF fragment are present in the same formulation. In particular embodiments, the FVIII protein and the VWF fragment are separate components of a single formulation. In certain embodiments, the FVIII protein, e.g., single chain FVIII, FVIII-Fc, pegylated FVIII, full length mature FVIII, or B domain deleted FVIII, is administered at a dose disclosed herein, e.g., 25 IU/kg, 30 IU/kg, 35 IU/kg, 40 IU/kg, 45 IU/kg, 50 IU/kg, 55 IU/kg, 60 IU/kg, or 65 IU/kg, and at a doing interval of at least 6 days, at least 7 days, at least 8 days, at least 9 days, at least 10 days, at least 11 days, at least 12 days, at least 13 days, or at least 14 days, and the VWF fragment is administered at a dose of at least about 0.25:1, 0.5:1, 1:1, 2:1, 3:1, 4:1, 5:1, 10:1, 15:1, 20:1, 25:1, 30:1, 35:1, 40:1, 45:1, 50:1, 100:1, 200:1, 300:1, 400:1, 500:1, 1000:1, 2000:1, 3000:1, 4000:1, 5000:1, 10,000:1, 50,000:1, 100,000:1, or 500,000:1 VWF fragment to FVIII molecule administered. In other embodiments, the VWF fragment is administered to the subject concurrently with, right after, or right before the FVIII protein. In certain embodiments, the VWF fragment is administered about 0.5 hours, about 1 hour, about 1.5 hours, about 2 hours, about 2.5 hours, about 3 hours, about 3.5 hours, about 4 hours, about 4.5 hours, about 5 hours, about 5.5 hours, or about 6 hours before the FVIII protein. In other embodiments, the FVIII protein is administered about 0.5 hours, about 1 hour, about 1.5 hours, about 2 hours, about 2.5 hours, about 3 hours, about 3.5 hours, about 4 hours, about 4.5 hours, about 5 hours, about 5.5 hours, or about 6 hours before the VWF fragment.

C. Immune Tolerance Induction

Certain aspects of the present disclosure are directed to methods of treating hemophilia A in a subject in need thereof, comprising administering to the subject a chimeric polypeptide comprising a FVIII protein and a VWF fragment at a dosing interval, wherein the chimeric polypeptide induces immune tolerance to FVIII in the subject. Some aspects of the present disclosure are directed to methods of treating hemophilia A in a subject in need thereof, comprising administering to the subject a chimeric polypeptide comprising a FVIII protein and a VWF fragment at a dosing interval, wherein the chimeric polypeptide reduces an inhibitory response to FVIII in the subject. Some aspects of the present disclosure are directed to methods of treating hemophilia A in a subject in need thereof, comprising administering to the subject a chimeric polypeptide comprising a FVIII protein and a VWF fragment at a dosing interval, wherein the chimeric polypeptide does not induce an immune response to the chimeric polypeptide following the administration. Another aspect of the present disclosure is directed to a method of inducing immune tolerance in a human with hemophilia, comprising (1) administering to the human an effective amount of a chimeric polypeptide described herein, e.g., rFVIIIFc-VWF-XTEN, wherein the effective amount of the chimeric polypeptide induces immune tolerance in the human. Various methods of immune tolerance induction using chimeric polypeptides comprising a FVIII and an Fc are disclosed in International Publication No. WO 2018/102760 A1, which is incorporated by reference herein in its entirety.

In certain embodiments, the method further comprises (2) following induction of immune tolerance, administering to the human a tapering regimen of the composition or the chimeric polypeptide. In certain embodiments, induction of immune tolerance occurs when the titer of the inhibitory antibodies in the human is less than about 0.6 BU. In certain embodiments, induction of immune tolerance occurs when the titer of the inhibitory antibodies in the human is less than about 0.6 BU, and 60% recovery of clotting factor activity as monitored in plasma. In some embodiments of the present disclosure, the method further comprises (3) following the tapering regimen, administering to the human a prophylactic dose of the clotting factor, e.g., a chimeric polypeptide described herein, e.g., rFVIIIFc-VWF-XTEN.

In certain aspects, the human has not been treated with a previous immune tolerance therapy against the clotting factor, e.g., against a FVIII. The chimeric polypeptide, e.g., rFVIIIFc-VWF-XTEN, can be administered to the human at any time it has been determined that the human has developed an inhibitor immune response, e.g., after measuring the level of an inhibitory immune response in the human. In other embodiments, the chimeric polypeptide, e.g., rFVIIIFc-VWF-XTEN, can be administered to the human who has not yet developed one or more inhibitor immune response to prevent development of an inhibitor immune response. In some embodiments, the chimeric polypeptide, e.g., rFVIIIFc-VWF-XTEN, is administered to the human who has a high likelihood (e.g., family history, genetic predisposition, or showing of a biomarker) of developing an inhibitor immune response. In some embodiments, the method further comprises measuring the level of an inhibitory immune response or the likelihood of developing an inhibitor immune response before the administration.

In some embodiments, the chimeric polypeptide, e.g., rFVIIIFc-VWF-XTEN, is administered to the human less than about 1 day, less than about 2 days, less than about 3 days, less than about 4 days, less than about 5 days, less than about 6 days, less than about 7 days, less than about 2 weeks, less than about 3 weeks, less than about 4 weeks, less than about 2 months, less than about 3 months, less than about 4 months, less than about 5 months, less than about 6 months, less than about 1 year, less than about 2 years, less than about 3 years, less than about 4 years, or less than about 5 years after it has been determined that the human has developed an inhibitor immune response or that the human has a likelihood of developing an inhibitor immune response, e.g., after measuring the level of an inhibitory immune response or the likelihood of developing an inhibitor immune response in the human. In certain embodiments, the chimeric polypeptide, e.g., rFVIIIFc-VWF-XTEN, is administered to the human immediately after it has been determined that the human has developed an inhibitor immune response or that the human has a likelihood of developing an inhibitor immune response, e.g., after measuring the level of an inhibitory immune response or the likelihood of developing an inhibitor immune response in the human. In particular embodiments, the chimeric polypeptide, e.g., rFVIIIFc-VWF-XTEN, is administered to the human less than about 5 minutes, less than about 10 minutes, less than about 15 minutes, less than about 20 minutes, less than about 30 minutes, less than about 45 minutes, less than about 1 hour, less than about 2 hours, less than about 3 hours, less than about 4 hours, less than about 5 hours, less than about 6 hours, less than about 7 hours, less than about 8 hours, less than about 9 hours, less than about 10 hours, less than about 11 hours, less than about 12 hours, about 18 hours, or less than about 24 hours after it has been determined that the human has developed an inhibitor immune response or that the human has a likelihood of developing an inhibitor immune response, e.g., after measuring the level of an inhibitory immune response or the likelihood of developing an inhibitor immune response in the human. In particular embodiments, the chimeric polypeptide, e.g., rFVIIIFc-VWF-XTEN, is administered to the human about 5 minutes, about 10 minutes, about 15 minutes, about 20 minutes, about 30 minutes, about 45 minutes, about 1 hour, about 2 hours, about 3 hours, about 4 hours, about 5 hours, about 6 hours, about 7 hours, about 8 hours, about 9 hours, about 10 hours, about 11 hours, about 12 hours, about 18 hours, or about 24 hours after it has been determined that the human has developed an inhibitor immune response or that the human has a likelihood of developing an inhibitor immune response, e.g., after measuring the level of an inhibitory immune response or the likelihood of developing an inhibitor immune response in the human. In certain embodiments, the chimeric polypeptide, e.g., rFVIIIFc-VWF-XTEN, is administered to the human less than about 1 day after it has been determined that the human has developed an inhibitor immune response or that the human has a likelihood of developing an inhibitor immune response, e.g., after measuring the level of an inhibitory immune response or the likelihood of developing an inhibitor immune response in the human.

Induction of an immune response can be continued until the level of inhibitor is lower than a certain level or until inhibitors are not detectable. In certain embodiments, the induction period can continue for at least about 24 weeks, at least about 26 weeks, at least about 28 weeks, at least about 30 weeks, at least about 32 weeks, at least about 34 weeks, at least about 36 weeks, at least about 38 weeks, at least about 40 weeks, at least about 42 weeks, at least about 44 weeks, at least about 46 weeks, at least about 48 weeks, at least about 50 weeks, at least about 52 weeks, at least about 54 weeks, at least about 56 weeks, at least about 58 weeks, at least about 60 weeks, at least about 62 weeks, at least about 64 weeks, at least about 66 weeks, at least about 68 weeks, at least about 70 weeks. In a particular embodiment, the induction period is less than 60 weeks.

The inhibitory immune response treated by the methods of the present invention can include any response within the human that negatively impacts one or more effects of a clotting factor treatment. In some embodiments, the inhibitory immune response comprises production of inhibitory antibodies against the clotting factor, e.g., inhibitory anti-FVIII antibodies. In certain embodiments, the method of the present disclosure further comprises measuring the titer of one or more inhibitory antibodies in the human before (e.g., at baseline) and after administering an effective amount of a chimeric polypeptide described herein, e.g., rFVIIIFc-VWF-XTEN, or a polynucleotide encoding the same. In some embodiments, titer of the inhibitory antibodies prior to the administration (e.g., at baseline) is at least about 0.6 Bethesda Units (BU). In certain embodiments, the titer of the inhibitory antibodies prior to the administration (e.g., at baseline) is at least about 1 BU, at least about 2 BU, at least about 3 BU, at least about 4 BU, at least about 5 BU, at least about 6 BU, at least about 7 BU, at least about 10 BU, at least about 20 BU, at least about 30 BU, at least about 40 BU, at least about 50 BU, at least about 100 BU, at least about 150 BU, or at least about 200 BU. In one particular embodiment, the titer of the inhibitory antibodies prior to the administration (e.g., at baseline) is at least about 5 BU.

In some embodiments, the methods of the present invention reduce the titer of inhibitory antibodies in a human subject relative to the titer of the inhibitory antibodies prior to the administration. In certain embodiments, the titer of the inhibitory antibodies after the administration is less than about 0.6 BU. In some embodiments, the titer of the inhibitory antibodies after the administration is less than about 0.5 BU, less than about 0.4 BU, less than about 0.3 BU, less than about 0.2 BU, or less than about 0.1 BU. In one particular embodiment, the titer of the inhibitory antibodies after the administration is 0 BU. In other embodiments, the titer of the inhibitory antibodies after the administration is less than 5 BU, less than 4 BU, less than 3 BU, less than 2 BU, less than 1 BU, less than 0.9 BU, less than 0.8 BU, less than 0.7 BU, or less than 0.6 BU.

In some embodiments, the administration of a chimeric polypeptide described herein, e.g., rFVIIIFc-VWF-XTEN, increases the differentiation of macrophages in the human towards an M2-like phenotype, as compared to macrophage differentiation in untreated controls and humans treated with the clotting factor alone. In some embodiments, the M2-like phenotype comprises upregulation of the NRF2 pathway, the PPAR gamma pathway, or both the NRF2 pathway and the PPAR gamma pathway. In some embodiments, the M2-like phenotype comprises upregulation of CD206 (MRC1). In some embodiments, the M2-like phenotype comprises upregulation of ARG1. In some embodiments, the M2-like phenotype comprises upregulation of CD206 (MRC1) and ARG1.

In some embodiments, the administration of a chimeric polypeptide described herein, e.g., rFVIIIFc-VWF-XTEN, results in greater expression of one or more genes in the human, relative to the expression of the one or more genes in an untreated subject or in a subject treated with the clotting factor alone. In some embodiments, the administration results in greater expression of one or more genes selected from the group consisting of Hmox1, PPAR gamma, LPL, EGR2, SLCO4A1, heme oxygenase 1 (HO-1), oxidative stress induced growth inhibitor 1 (OSGIN1), superoxide dismutase 1 (SOD1), glutathione-disulfide reductase (GSR), glutamate-cysteine ligase catalytic subunit (GCLC), glutamate-cysteine ligase modifier subunit (GCLM), NAD(P)H quinone dehydrogenase 1 (NQO1), fatty acid binding protein 5 (FABP5), B7-H3 (CD276), SLAM family member 3 (SLAMF3; lymphocyte antigen 9; LY9), SLAM family member 7 (SLAMF7), mannose receptor C-type 1 (MRC1), solute carrier family 12 member 4 (SLC12A), neuropilin 1 (NRP1), and any combination thereof. In some embodiments, the administration results in greater expression of one or more genes of the NRF2 pathway. In certain embodiments, the one or more genes of the NRF2 pathway are selected from the group consisting of HO-1, OSGIN1, SOD1, GSR, GCLC, GCLM, NQO1, and any combination thereof. In some embodiments, the administration results in greater expression of one or more genes of the PPAR gamma pathway. In some embodiments, the one or more genes of the PPAR gamma pathway are selected from the group consisting of PPAR gamma, LPL, FABP5, EGR2, and any combination thereof. In some embodiments, the administration results in greater expression of one or more genes selected from the group consisting of B7-H3 (CD276), SLAMF3, SLAMF7, MRC1, SLC12A, NRP1, and any combination thereof. In particular embodiments, the administration results in greater expression of the one or more genes relative to the expression of the one or more genes in an untreated human or a human administered the clotting factor alone, wherein the expression is at least about 1.5 fold greater, at least about 2 fold greater, at least about 2.5 fold greater, at least about 3 fold greater, at least about 3.5 fold greater, at least about 4 fold greater, at least about 4.5 fold greater, or at least about 5 fold greater.

In some embodiments, the differential expression of the one or more genes is observed less than 6 hours after the administration of a chimeric polypeptide described herein, e.g., rFVIIIFc-VWF-XTEN. In some embodiments, the differential expression is observed less than 12 hours after administration. In some embodiments, the differential expression is observed less than 18 hours after administration. In some embodiments, the differential expression is observed less than 24 hours after administration.

In some embodiments, the inhibitory immune response comprises a cell-mediated immune response. In certain embodiments, the cell-mediated immune response comprises the release of a cytokine. In some embodiments, the cytokine is any cytokine associated with an increased immune response. In some embodiments, the cytokine selected from the group consisting of IL-1, IL-6, IL-16, IL-12, IL-4, IL-17, tumor necrosis factor α (TNF-α), interferon α, interferon γ and any combination thereof. In one embodiment, the cell-mediated immune response comprises increased serum levels of IL-12. In another embodiment, the cell-mediated immune response comprises increased serum levels of IL-4. In another embodiment, the cell-mediated immune response comprises increased serum levels of IL-17. In another embodiment, the cell-mediated immune response comprises increased serum levels of TNF-α.

Various gene mutations have been linked with an increased risk of developing an inhibitory immune response. For example, the TNF-α-308G>A polymorphism within Hap2, which is associated with increased constitutive and inducible transcription levels of TNF has been linked with an increased risk of developing an inhibitory immune response. See Astermark et al., Blood 108: 3739-3745 (2006), which is herein incorporated by reference in its entirety. Thus, in some embodiments, the human has a genetic polymorphism associated with increased TNF-α. In some embodiments, the polymorphism is the TNF-α-308G>A polymorphism. In some embodiments, the human has a polymorphism in an 11_10 gene, e.g. a polymorphism associated with increased secretion of IL10. In some embodiments, FVIII-Fc is administered to a subject with the allele 134 of the IL10G microsatellite in the promote region of the IL10 gene. See Astermark et al. Hemostatis, Thrombosis, and Vascular Biology 108: 3739-3745 (2006), which is herein incorporated by reference in its entirety.

In some embodiments, the human has a genetic polymorphism associated with decreased CTLA-4 (Cytotoxic T-Lymphocyte Antigen 4) expression. In some embodiments, the human has a mutation in DR15 (HLA-DR15) or DQB0602 MHC (Major histocompatibility complex) Class II molecules. Other MHC Class II molecules associated with the development of an inhibitory immune response in subjects with hemophilia are A3, B7, C7, DQA0102, C2, DQA0103, DQB0603, and DR13 (see Inhibitors in Patients with Hemophilia, E. C. Rodriguez-Merchan & C. A. Lee, Eds., Blackwell Science, Ltd, 2002).

In some embodiments, the methods of the present disclosure reduce the level of one or more cytokine in the subject compared to the level of the one or more cytokines in the subject after a previous treatment with a polypeptide consisting of a FVIII protein. In another embodiment, the methods of the present disclosure reduce the level of one or more cytokine in the subject compared to the level of the one or more cytokines in the subject prior to the administration. In other embodiments, the expression of one or more tolerogenic molecules is increased after the administration of the methods of the present disclosure relative to the expression level of the one or more tolerogenic molecules prior to the administration. In certain embodiments, the one or more tolerogenic molecules is selected from IL-10, TGF-β, IL-35, IDO-1, and any combination thereof.

In other embodiments, the immune response comprises a clinical symptom selected from the group consisting of: increased bleeding tendency, high clotting factor consumption, lack of response to clotting factor therapy, decreased efficacy of clotting factor therapy, shortened half-life of the clotting factor, and any combination thereof. In certain embodiments, the immune response comprises a clinical symptom selected from the group consisting of: increased bleeding tendency, high clotting factor consumption, lack of response to clotting factor therapy, decreased efficacy of clotting factor therapy, decreased recovery of clotting factor activity as monitored in the plasma, shortened half-life of the clotting factor, and any combination thereof.

In certain embodiments, the human was previously diagnosed as having an inhibitory immune response. Such a diagnosis can be made using any methods known in the art. For example, a human can be characterized as having an immune response to a clotting factor, e.g., a FVIII, if the human has one or more the following: (a) a titer of inhibitory antibodies to the clotting factor greater than or equal to 0.6 BU; (b) increased serum levels of one or more cytokine selected from the group consisting of IL-12, IL-4, IL-17, and TNF-α; (c) increased bleeding tendency; (d) high clotting factor consumption; (e) a lack of response to clotting factor therapy; (f) decreased efficacy of clotting factor therapy; (g) shortened half-life of the clotting factor, and any combination thereof. In one particular embodiment, the human is characterized as having an immune response to a clotting factor if the human has a titer of inhibitory antibodies to the clotting factor greater than or equal to 0.6 BU.

In some embodiments, the human was previously diagnosed as having developed an inhibitory immune response to the clotting factor at least about 1 month, at least about 2 months, at least about 3 months, at least about 4 months, at least about 5 months, at least about 6 months, at least about 7 months, at least about 8 months, at least about 9 months, at least about 10 months, at least about 11 months, at least about 12 months, at least about 13 months, at least about 14 months, at least about 15 months, at least about 16 months, at least about 17 months, at least about 18 months, at least about 19 months, at least about 20 months, at least about 21 months, at least about 22 months, at least about 23 months, at least about 24 months, at least about 27 months, at least about 30 months, at least about 33 months, at least about 36 months, at least about 39 months, at least about 42 months, at least about 45 months, at least about 48 years, at least about 51 months, at least about 54 months, at least about 57 months, at least about 60 months, at least about 6 years, at least about 7 years, at least about 8 years, at least about 10 years, at least about 15 years, or at least about 20 years prior to the administration. In one embodiment, the human was previously diagnosed as having developed an inhibitory immune response to the clotting factor at least about 5 years prior to the administration.

In some embodiments, the methods of the present disclosure provide an improved time to tolerance as compared to standard of care methods of inducing immune tolerance. The term "time to tolerance," as used herein refers to the amount of time between the administration of the first dose of the composition or the chimeric protein comprising a clotting factor and an Fc region and the development of immune tolerance in the human. Decreasing the time to tolerance can have significant benefits for the human, including but not limited to reducing the total financial burden required to achieve tolerance. In some embodiments, the time to tolerance is about 1 to about 24 weeks, about 1 to about 23 weeks, about 1 to about 22 weeks, about 1 to about 21 weeks, about 2 to about 20 weeks, about 2 to about 19 weeks, about 2 to about 18 weeks, about 2 to about 17 weeks, about 3 to about 16 weeks, about 3 to about 15 weeks, about 3 to about 14 weeks, about 3 to about 13 weeks, about 4 to about 12 weeks, about 4 to about 11 weeks, about 4 to about 10 weeks, about 4 to about 9 weeks, about 5 to about 8 weeks, about 5 to about 7 weeks, about 5 to about 6 weeks, about 1 to about 12 weeks, about 1 to about 11 weeks, about 1 to about 10 weeks, about 1 to about 9 weeks, about 1 to about 8 weeks, about 1 to about 7 weeks, about 1 to about 6 weeks, about 1 to about 5 weeks, or about 1 to about 4 weeks. In some embodiments, the time to tolerance is less than about 70 weeks, less than about 65 weeks, less than about 60 weeks, less than about 58 weeks, less than about 56 weeks, less than about 54 weeks, less than about 52 weeks, less than about 50 weeks, less than about 48 weeks, less than about 46 weeks, less than about 44 weeks, less than about 42 weeks, less than about 40 weeks, less than about 38 weeks, less than about 36 weeks, less than about 34 weeks, less than about 32 weeks, less than about 30 weeks, less than about 28 weeks, less than about 26 weeks, less than about 24 weeks, less than about 23 weeks, less than about 22 weeks, less than about 21 weeks, less than about 20 weeks, less than about 19 weeks, less than about 18 weeks, less than about 17 weeks, less than about 16 weeks, less than about 15 weeks, less than about 14 weeks, less than about 13 weeks, less than about 12 weeks, less than about 11 weeks, less than about 10 weeks, less than about 9 weeks, less than about 8 weeks, less than about 7 weeks, less than about 6 weeks, less than about 5 weeks, less than about 4 weeks, less than about 3 weeks, less than about 2 weeks, or less than about 1 week. In certain embodiments, the time to tolerance is about 4 to about 12 weeks. In one embodiment, the time to tolerance is about 4 weeks. In another embodiment, the time to tolerance is about 12 weeks. In some embodiments, the time to tolerance is less than about 10 months. In some embodiments, the time to tolerance is less than about 9 months. In some embodiments, the time to tolerance is less than about 8 months. In some embodiments, the time to tolerance is less than about 7 months. In some embodiments, the time to tolerance is less than about 6 months. In some embodiments, the time to tolerance is less than about 5 months. In some embodiments, the time to tolerance is less than about 4 months. In some embodiments, the methods of the present disclosure result in a shorter time to tolerance in the human following treatment with a composition or the chimeric protein comprising a clotting factor and an Fc region as compared to the time to tolerance following treatment with the clotting factor alone.

In some embodiments, development of immune tolerance is characterized by a titer of an inhibitory antibody to the clotting factor of less than about 0.6 BU. In some embodiments, development of immune tolerance is characterized by a titer of an inhibitory antibody to the clotting factor of than about 0.5 BU. In some embodiments, development of immune tolerance is characterized by a titer of an inhibitory antibody to the clotting factor of less than about 0.4 BU. In some embodiments, development of immune tolerance is characterized by a titer of an inhibitory antibody to the clotting factor of less than about 0.3 BU. In some embodiments, development of immune tolerance is characterized by a titer of an inhibitory antibody to the clotting factor of less than about 0.2 BU. In some embodiments, development of immune tolerance is characterized by a titer of an inhibitory antibody to the clotting factor of less than about 0.1 BU. In some embodiments, development of immune tolerance is characterized by a titer of an inhibitory antibody to the clotting factor of 0.0 BU. In certain embodiments, the titer of inhibitory immune antibodies is observed at two consecutive measurements, e.g., in two consecutive weeks within a four-week period.

In some embodiments, the development of immune tolerance is characterized by incremental recovery >66% (e.g., incremental recovery of about 67%, about 68%, about 69%, about 70%, about 71%, about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100%). As used herein, "incremental recovery" refers to peak FVIII levels 15-30 minutes after infusion.

After the induction period and tapering period are completed, the subject can then be on prophylactic treatment of the chimeric protein. The prophylactic dosing regimen can be any dosing regimen disclosed herein.

In some embodiments, the human treated using the methods of the present disclosure is receiving or has recently received an immunostimulatory therapy. For example, inhibitors have also been reported in HCV positive hemophilia A patients undergoing treatment with interferon as well as in HIV positive hemophilia A patients having an immune reconstitution inflammatory syndrome associated with anti-retroviral therapy. See Report of Expert Meeting on FVIII Products and Inhibitor Development, European Medicines Agency (Feb. 28, 2006-Mar. 2, 2006). Thus, in some embodiments, the human is receiving interferon therapy. In some embodiments, the human is receiving anti-viral therapy. In some embodiments, the human is receiving an anti-retroviral therapy and having an immune reconstitution inflammatory syndrome.

In certain embodiments, the human has had less than 150 exposure days (ED) to the clotting factor, e.g. FVIII. In one embodiment, the human has had less than 50 ED. In another embodiment, the human has had less than 20 ED.

Some aspects of the present disclosure are directed to methods of reducing the severity or occurrence of an allergic or anaphylactic reaction to a clotting factor in a subject in need thereof, comprising administering to the subject a composition or a chimeric protein comprising the clotting factor and an Fc region. In some embodiments, the administration of the composition or the chimeric protein reduces the severity of an anaphylactoid reaction to the clotting factor. In some embodiments, the administration of the composition or the chimeric protein reduces the severity of an allergic reaction to the clotting factor.

III. Chimeric Polypeptides

Chimeric polypeptides useful for the present disclosure comprise a FVIII protein comprising a FVIII polypeptide and a VWF fragment comprising a D' domain and a D3 domain of VWF. The VWF fragment is used to prevent or block the FVIII protein from interacting with endogenous VWF, thereby preventing the FVIII protein from being cleared through a VWF clearance pathway. In order to prevent dissociation of the FVIII protein from the VWF fragment, in some embodiments, the FVIII protein and the VWF fragment are associated directly or indirectly with each other through an association stronger than the natural interaction between FVIII and VWF.

In certain embodiments, the FVIII protein is associated with the VWF fragment by a covalent bond. The covalent bond can be any covalent bond known in the art. In some embodiments, the covalent bond is a disulfide bond. In some embodiments, the covalent bond is a peptide bond. In other embodiments, the FVIII protein is modified to increase the strength of the interaction between the FVIII protein and the VWF fragment. In other embodiments, the VWF fragment is modified to increase the strength of the interaction between the FVIII protein and the VWF fragment. In still other embodiments, the FVIII protein and the VWF protein both are modified to increase the strength of the interaction between the FVIII protein and the VWF fragment.

In particular embodiments, the FVIII protein comprising a FVIII polypeptide and the VWF fragment comprising a D' domain and a D3 domain of VWF associate directly through at least one covalent bond between at least one amino acid in the FVIII polypeptide sequence and at least one amino acid in the D' and D3 domains of VWF. In other embodiments, the FVIII protein and the VWF fragment associate indirectly through at least one covalent bond between at least one amino acid in the FVIII polypeptide sequence and at least one amino acid in a heterologous sequence fused directly or indirectly with the D' and D3 domains of VWF. In other embodiments, the FVIII protein and the VWF fragment associate indirectly through at least one covalent bond between at least one amino acid in the VWF fragment sequence and at least one amino acid in a heterologous sequence fused directly or indirectly with the FVIII polypeptide. In still other embodiments, the FVIII protein and the VWF fragment associate indirectly through at least one covalent bond between at least one amino acid in a heterologous sequence fused directly or indirectly with the D' and D3 domains of VWF and at least one amino acid in a heterologous sequence fused directly or indirectly with the FVIII polypeptide.

The FVIII protein of the present disclosure can comprise a FVIII polypeptide and one or more heterologous moieties, e.g., half-life extending moieties, fused directly or indirectly with the FVIII polypeptide. The VWF fragment of the present disclosure can also comprise a D' domain and a D3 domain of VWF and one or more heterologous moieties, e.g., half-life extending moieties, fused directly or indirectly with the D' and D3 domains of VWF. In some embodiments, the FVIII protein useful for the present disclosure consists essentially of or consists of a FVIII polypeptide and the VWF fragment useful for the disclosure comprises a D' domain and a D3 domain of VWF and one or more heterologous moieties, e.g., half-life extending moieties, fused directly or indirectly with the D' and D3 domains of VWF. In some embodiments, the FVIII protein comprises a FVIII polypeptide and one or more heterologous moieties, e.g., half-life extending moieties, fused directly or indirectly with the FVIII polypeptide and the VWF fragment useful for the present disclosure consists essentially of or consists of a D' domain and a D3 domain of VWF. In some embodiments, the chimeric polypeptide comprises a FVIII protein consists essentially of or consists of a FVIII polypeptide and a VWF fragment consists essentially of or consists of a D' domain and a D3 domain of VWF.

In some embodiments, the chimeric polypeptide or protein disclosed herein is a FVIII-XTEN-Fc/D'D3-XTEN-Fc heterodimer. In one embodiment, the FVIII-XTEN-Fc/D'D3-XTEN-Fc heterodimer chimeric polypeptide comprises: (i) a FVIII protein comprising a FVIII polypeptide, an XTEN inserted within the B domain of the FVIII polypeptide, and a first Fc region; and (ii) a VWF protein comprising a VWF fragment, a second XTEN sequence, an a2 linker, and a second Fc region. A schematic representation of an exemplary FVIII-XTEN-Fc/D'D3-XTEN-Fc heterodimer, rFVIIIFc-VWF-XTEN, is presented in FIG. 1.

In a specific embodiment, the chimeric polypeptide is rFVIIIFc-VWF-XTEN. In another specific embodiment, rFVIIIFc-VWF-XTEN comprises (i) a FVIII protein comprising the amino acid sequence of SEQ ID NO: 203 and (ii) a VWF protein comprising the amino acid sequence of SEQ ID NO: 205. In yet another specific embodiment, rFVIIIFc-VWF-XTEN comprises (i) a FVIII protein and (ii) a VWF protein that are covalently linked via a disulfide bond.

III.A. Factor VIII Polypeptides

"Factor VIII," abbreviated throughout the instant application as "FVIII," as used herein, means functional FVIII polypeptide in its normal role in coagulation, unless otherwise specified. Thus, the term FVIII includes variant polypeptides that are functional. "A FVIII protein" is used to refer to a FVIII polypeptide (or protein) alone, a FVIII polypeptide fused to additional polypeptides, and a FVIII polypeptide associated with one or more additional polypeptides as long as the FVIII protein exhibits a FVIII function/activity. The terms "FVIII polypeptide," "FVIII portion," and "FVIII" refer to the FVIII polypeptide sequence alone. Examples of the FVIII functions/activities include, but are not limited to, an ability to activate coagulation, an ability to act as a cofactor for factor IX, or an ability to form a tenase complex with factor IX in the presence of $Ca^{2+}$ and phospholipids, which then converts Factor X to the activated form Xa. The FVIII polypeptide can be the human, porcine, canine, rat, or murine FVIII polypeptide. In addition, comparisons between FVIII from humans and other species have identified conserved residues that are likely to be required for function (Cameron et al., Thromb. Haemost. 79:317-22 (1998); U.S. Pat. No. 6,251, 632). The full-length polypeptide and polynucleotide sequences are known, as are many functional fragments, mutants and modified versions. Various FVIII amino acid and nucleotide sequences are disclosed in, e.g., US Publication Nos. 2015/0158929 A1, 2014/0308280 A1, and 2014/0370035 A1 and International Publication No. WO 2015/106052 A1. FVIII polypeptides include, e.g., full-length FVIII, full-length FVIII minus Met at the N-terminus, mature FVIII polypeptide (minus the signal sequence), mature FVIII polypeptide with an additional Met at the N-terminus, and/or FVIII polypeptide with a full or partial deletion of the B domain. FVIII variants include B domain deletions, whether partial or full deletions.

The FVIII polypeptide of the chimeric polypeptide used herein has FVIII activity in the plasma. FVIII activity can be measured by any known methods in the art. A number of tests are available to assess the function of the coagulation system: activated partial thromboplastin time (aPTT) test, chromogenic assay, ROTEM assay, prothrombin time (PT) test (also used to determine INR), fibrinogen testing (often by the Clauss method), platelet count, platelet function testing (often by PFA-100), TCT, bleeding time, mixing test (whether an abnormality corrects if the patient's plasma is mixed with normal plasma), coagulation factor assays, antiphospholipid antibodies, D-dimer, genetic tests (e.g., factor V Leiden, prothrombin mutation G20210A), dilute Russell's viper venom time (dRVVT), miscellaneous platelet function tests, thromboelastography (TEG or Sonoclot), thromboelastometry (TEM®, e.g., ROTEM®), or euglobulin lysis time (ELT).

The aPTT test is a performance indicator measuring the efficacy of both the "intrinsic" (also referred to the contact activation pathway) and the common coagulation pathways. This test is commonly used to measure clotting activity of commercially available recombinant clotting factors, e.g., FVIII. It is typically used in conjunction with prothrombin time (PT), which measures the extrinsic pathway. (See, e.g., Kamal et al., Mayo Clin Proc., 82(7):864-873 (2007)). In one embodiment, aPTT is tested using an assay where FVIII activity is measured using the Dade® Actin® FSL Activated PTT Reagent (Siemens Health Care Diagnostics) on a BCS® XP analyzer (Siemens Healthcare Diagnostics). In certain embodiments, the chimeric polypeptide has a plasma FVIII activity of at least about 1%, at least about 2%, at least about 3%, at least about 4%, at least about 5%, at least about 6%, at least about 7%, at least about 8%, at least about 9%, at least about 10%, at least about 11%, at least about 12%, at least about 13%, at least about 14%, at least about 15%, at least about 15%, at least about 16%, at least about 17%, at least about 18%, at least about 19%, or at least about 20% as measured by aPTT test.

The aPTT assay may also be used for assessing the potency of a chimeric polypeptide prior to administration to a patient or subject. (Hubbard A R, et al. J Thromb Haemost 11: 988-9 (2013)). The aPTT assay may further be used in conjunction with any of the assays described herein, either prior to administration or following administration to a patient or subject.

ROTEM analysis provides information on the whole kinetics of haemostasis: clotting time, clot formation, clot stability and lysis. The different parameters in thromboelastometry are dependent on the activity of the plasmatic coagulation system, platelet function, fibrinolysis, or many factors which influence these interactions. This assay can provide a complete view of secondary haemostasis.

The chromogenic assay mechanism is based on the principles of the blood coagulation cascade, where activated FVIII accelerates the conversion of Factor X into Factor Xa in the presence of activated Factor IX, phospholipids and calcium ions. The Factor Xa activity is assessed by hydrolysis of a p-nitroanilide (pNA) substrate specific to Factor Xa. The initial rate of release of p-nitroaniline measured at 405 nM is directly proportional to the Factor Xa activity and thus to the FVIII activity in the sample. In one embodiment, the chromogenic assay is the BIOPHEN FVIII:C assay (Hyphen Biomed, Neurville sur Oise, France)

The chromogenic assay is recommended by the FVIII and Factor IX Subcommittee of the Scientific and Standardization Committee (SSC) of the International Society on Thrombosis and Hemostatsis (ISTH). Since 1994, the chromogenic assay has also been the reference method of the European Pharmacopoeia for the assignment of FVIII concentrate potency. Thus, in some embodiments, the chimeric polypeptide comprising a FVIII polypeptide has FVIII activity comparable to a chimeric polypeptide comprising mature FVIII polypeptide or a BDD FVIII polypeptide (e.g., RECOMBINATE®, KOGENATE FS®, HELIXATE FS®, XYNTHA/REFACTO AB®, HEMOFIL-M®, MONARC-M®, MONOCLATE-P®, HUMATE-P®, ALPHANATE®, KOATE-DVI®, AFSTYLA®, AND HYATE:C®).

The chromogenic assay may also be used for assessing the potency of a chimeric polypeptide prior to administration to a patient or subject. (Hubbard A R, et al. J Thromb Haemost 11: 988-9 (2013)). The chromogenic assay may further be used in conjunction with any of the assays described herein, either prior to administration or following administration to a patient or subject.

In other embodiments, the chimeric polypeptide comprising a FVIII polypeptide of this disclosure has a Factor Xa generation rate comparable to a chimeric polypeptide comprising a mature FVIII polypeptide or a BDD FVIII polypeptide (e.g., ADVATE®, REFACTO®, or ELOCTATE®).

In order to activate Factor X to Factor Xa, activated Factor IX (Factor IXa) hydrolyzes one arginine-isoleucine bond in Factor X to form Factor Xa in the presence of $Ca^{2+}$, membrane phospholipids, and a FVIII cofactor. Therefore, the interaction of FVIII with Factor IX is critical in coagulation pathway. In certain embodiments, the chimeric polypeptide comprising a FVIII polypeptide can interact with Factor IXa at a rate comparable to a chimeric polypeptide comprising a mature FVIII polypeptide sequence or a BDD FVIII polypeptide (e.g., ADVATE®, REFACTO®, or ELOCTATE®).

In addition, FVIII is bound to von Willebrand Factor while inactive in circulation. FVIII degrades rapidly when not bound to VWF and is released from VWF by the action of thrombin. In some embodiments, the chimeric polypeptide comprising a FVIII polypeptide binds to von Willebrand Factor, e.g., a VWF fragment disclosed herein, at a level comparable to a chimeric polypeptide comprising a mature FVIII polypeptide sequence or a BDD FVIII polypeptide (e.g., ADVATE®, REFACTO®, or ELOCTATE®).

FVIII can be inactivated by activated protein C in the presence of calcium and phospholipids. Activated protein C cleaves FVIII heavy chain after Arginine 336 in the A1 domain, which disrupts a Factor X substrate interaction site, and cleaves after Arginine 562 in the A2 domain, which enhances the dissociation of the A2 domain as well as disrupts an interaction site with the Factor IXa. This cleavage also bisects the A2 domain (43 kDa) and generates A2-N (18 kDa) and A2-C (25 kDa) domains. Thus, activated protein C can catalyze multiple cleavage sites in the heavy chain. In some embodiments, the chimeric polypeptide comprising a FVIII polypeptide is inactivated by activated Protein C at a level comparable to a chimeric polypeptide comprising a mature FVIII polypeptide sequence or a BDD FVIII polypeptide (e.g., ADVATE®, REFACTO®, or ELOCTATE®).

In other embodiments, the chimeric polypeptide comprising a FVIII polypeptide has FVIII activity in vivo comparable to a chimeric polypeptide comprising a mature FVIII polypeptide sequence or a BDD FVIII polypeptide (e.g., ADVATE®, REFACTO®, or ELOCTATE®). In a particular embodiment, the chimeric polypeptide comprising a FVIII polypeptide is capable of protecting a HemA mouse at a level comparable to a chimeric polypeptide comprising a mature FVIII polypeptide sequence or a BDD FVIII polypeptide (e.g., ADVATE®, REFACTO®, or ELOCTATE®) in a HemA mouse tail vein transection model.

Examples of human FVIII sequences (full-length) are shown below.

TABLE 2

Amino Acid Sequence of Full-length Human Factor VIII (Full-length FVIII: FVIII signal peptide underlined; FVIII heavy chain is double underlined; B domain is italicized; and FVIII light chain is in plain text)

Signal Peptide: (SEQ ID NO: 64)

MQIELSTCFFLCLLRFCFS

Mature Factor VIII (SEQ ID NO: 65)*

<u>ATRRYYLGAVELSWDYMQSDLGELPVDARFPPRVPKSFPFNTSVVYKKTL</u>

<u>FVEFTDHLFNIAKPRPPWMGLLGPTIQAEVYDTVVITLKNMASHPVSLHA</u>

<u>VGVSYWKASEGAEYDDQTSQREKEDDKVFPGGSHTYVWQVLKENGPMASD</u>

<u>PLCLTYSYLSHVDLVKDLNSGLIGALLVCREGSLAKEKTQTLHKFILLFA</u>

<u>VFDEGKSWHSETKNSLMQDRDAASARAWPKMHTVNGYVNRSLPGLIGCHR</u>

<u>KSVYWHVIGMGTTPEVHSIFLEGHTFLVRNHRQASLEISPITFLTAQTLL</u>

<u>MDLGQFLLFCHISSHQHDGMEAYVKVDSCPEEPQLRMKNNEEAEDYDDDL</u>

<u>TDSEMDVVRFDDDNSPSFIQIRSVAKKHPKTWVHYIAAEEEDWDYAPLVL</u>

<u>APDDRSYKSQYLNNGPQRIGRKYKKVRFMAYTDETFKTREAIQHESGILG</u>

<u>PLLYGEVGDTLLIIFKNQASRPYNIYPHGITDVRPLYSRRLPKGVKHLKD</u>

<u>FPILPGEIFKYKWTVTVEDGPTKSDPRCLTRYYSSFVNMERDLASGLIGP</u>

<u>LLICYKESVDQRGNQIMSDKRNVILFSVFDENRSWYLTENIQRFLPNPAG</u>

<u>VQLEDPEFQASNIMHSINGYVFDSLQLSVCLHEVAYWYILSIGAQTDFLS</u>

<u>VFFSGYTFKHKMVYEDTLTLFPFSGETVFMSMENPGLWILGCHNSDFRNR</u>

<u>GMTALLKVSSCDKNTGDYYEDSYEDISAYLLSKNNAIEPR</u>*SFSQNSRHPS*

*TRQKQFNATTIPENDIEKTDPWFAHRTPMPKIQNVSSSDLLMLLRQSPTP*

*HGLSLSDLQEAKYETFSDDPSPGAIDSNNSLSEMTHFRPQLHHSGDMVFT*

*PESGLQLRLNEKLGTTAATELKKLDFKVSSTSNNLISTIPSDNLAAGTDN*

*TSSLGPPSMPVHYDSQLDTTLFGKKSSPLTESGGPLSLSEENNDSKLLES*

*GLMNSQESSWGKNVSSTESGRLFKGKRAHGPALLTKDNALFKVSISLLKT*

*NKTSNNSATNRKTHIDGPSLLIENSPSVWQNILESDTEFKKVTPLIHDRM*

*LMDKNATALRLNHMSNKTTSSKNMEMVQQKKEGPIPPDAQNPDMSFFKML*

TABLE 2-continued

Amino Acid Sequence of Full-length Human Factor VIII (Full-length FVIII: FVIII signal peptide underlined; FVIII heavy chain is double underlined; B domain is italicized; and FVIII light chain is in plain text)

*FLPESARWIQRTHGKNSLNSGQGPSPKQLVSLGPEKSVEGQNFLSEKNKV*

*VVGKGEFTKDVGLKEMVFPSSRNLFLTNLDNLHENNTHNQEKKIQEEIEK*

*KETLIQENVVLPQIHTVTGTKNFMKNLFLLSTRQNVEGSYDGAYAPVLQD*

*FRSLNDSTNRTKKHTAHFSKKGEEENLEGLGNQTKQIVEKYACTTRISPN*

*TSQQNFVTQRSKRALKQFRLPLEETELEKRIIVDDTSTQWSKNMKHLTPS*

*TLTQIDYNEKEKGAITQSPLSDCLTRSHSIPQANRSPLPIAKVSSFPSIR*

*PIYLTRVLFQDNSSHLPAASYRKKDSGVQESSHFLQGAKKNNLSLAILTL*

*EMTGDQREVGSLGTSATNSVTYKKVENTVLPKPDLPKTSGKVELLPKVHI*

*YQKDLFPTETSNGSPGHLDLVEGSLLQGTEGAIKWNEANRPGKVPFLRVA*

*TESSAKTPSKLLDPLAWDNHYGTQIPKEEWKSQEKSPEKTAFKKKDTILS*

LNACESNHAIAAINEGQNKPEIEVTWAKQGRTERLCSQNPPVLKRHQREI

TRTTLQSDQEEIDYDDTISVEMKKEDFDIYDEDENQSPRSFQKKTRHYFI

AAVERLWDYGMSSSPHVLRNRAQSGSVPQFKKVVFQEFTDGSFTQPLYRG

ELNEHLGLLGPYIRAEVEDNIMVTFRNQASRPYSFYSSLISYEEDQRQGA

EPRKNFVKPNETKTYFWKVQHHMAPTKDEFDCKAWAYFSDVDLEKDVHSG

LIGPLLVCHTNTLNPAHGRQVTVQEFALFFTIFDETKSWYFTENMERNCR

APCNIQMEDPTFKENYRFHAINGYIMDTLPGLVMAQDQRIRWYLLSMGSN

ENIHSIHFSGHVFTVRKKEEYKMALYNLYPGVFETVEMLPSKAGIWRVEC

LIGEHLHAGMSTLFLVYSNKCQTPLGMASGHIRDFQITASGQYGQWAPKL

ARLHYSGSINAWSTKEPFSWIKVDLLAPMIIHGIKTQGARQKFSSLYISQ

FIIMYSLDGKKWQTYRGNSTGTLMVFFGNVDSSGIKHNIFNPPIIARYIR

LHPTHYSIRSTLRMELMGCDLNSCSMPLGMESKAISDAQITASSYFTNMF

ATWSPSKARLHLQGRSNAWRPQVNNPKEWLQVDFQKTMKVTGVTTQGVKS

LLTSMYVKEFLISSSQDGHQWTLFFQNGKVKVFQGNQDSFTPVVNSLDPP

LLTRYLRIHPQSWVHQIALRMEVLGCEAQDLY

TABLE 3

Nucleotide Sequence Encoding Full-Length FVIII (SEQ ID NO: 66)*
*The underlined nucleic acids encode a signal peptide.

661  <u>ATG CAAATAGAGC TCTCCACCTG</u>

721  <u>CTTCTTTCTG TGCCTTTTGC GATTCTGCTT</u> TAGTGCCACC AGAAGATACT ACCTGGGTGC

781  AGTGGAACTG TCATGGGACT ATATGCAAAG TGATCTCGGT GAGCTGCCTG TGGACGCAAG

841  ATTTCCTCCT AGAGTGCCAA AATCTTTTCC ATTCAACACC TCAGTCGTGT ACAAAAAGAC

901  TCTGTTTGTA GAATTCACGG ATCACCTTTT CAACATCGCT AAGCCAAGGC CACCCTGGAT

961  GGGTCTGCTA GGTCCTACCA TCCAGGCTGA GGTTTATGAT ACAGTGGTCA TTACACTTAA

1021 GAACATGGCT TCCCATCCTG TCAGTCTTCA TGCTGTTGGT GTATCCTACT GGAAAGCTTC

TABLE 3-continued

Nucleotide Sequence Encoding Full-Length FVIII (SEQ ID NO: 66)*
*The underlined nucleic acids encode a signal peptide.

```
1081 TGAGGGAGCT GAATATGATG ATCAGACCAG TCAAAGGGAG AAAGAAGATG ATAAAGTCTT
1141 CCCTGGTGGA AGCCATACAT ATGTCTGGCA GGTCCTGAAA GAGAATGGTC CAATGGCCTC
1201 TGACCCACTG TGCCTTACCT ACTCATATCT TTCTCATGTG GACCTGGTAA AAGACTTGAA
1261 TTCAGGCCTC ATTGGAGCCC TACTAGTATG TAGAGAAGGG AGTCTGGCCA AGGAAAAGAC
1321 ACAGACCTTG CACAAATTTA TACTACTTTT TGCTGTATTT GATGAAGGGA AAAGTTGGCA
1381 CTCAGAAACA AAGAACTCCT TGATGCAGGA TAGGGATGCT GCATCTGCTC GGGCCTGGCC
1441 TAAAATGCAC ACAGTCAATG GTTATGTAAA CAGGTCTCTG CCAGGTCTGA TTGGATGCCA
1501 CAGGAAATCA GTCTATTGGC ATGTGATTGG AATGGGCACC ACTCCTGAAG TGCACTCAAT
1561 ATTCCTCGAA GGTCACACAT TTCTTGTGAG GAACCATCGC CAGGCGTCCT TGGAAATCTC
1621 GCCAATAACT TTCCTTACTG CTCAAACACT CTTGATGGAC CTTGGACAGT TTCTACTGTT
1681 TTGTCATATC TCTTCCCACC AACATGATGG CATGGAAGCT TATGTCAAAG TAGACAGCTG
1741 TCCAGAGGAA CCCCAACTAC GAATGAAAAA TAATGAAGAA GCGGAAGACT ATGATGATGA
1801 TCTTACTGAT TCTGAAATGG ATGTGGTCAG GTTTGATGAT GACAACTCTC CTTCCTTTAT
1861 CCAAATTCGC TCAGTTGCCA GAAGCATCC TAAAACTTGG GTACATTACA TTGCTGCTGA
1921 AGAGGAGGAC TGGGACTATG CTCCCTTAGT CCTCGCCCCC GATGACAGAA GTTATAAAAG
1981 TCAATATTTG AACAATGGCC CTCAGCGGAT TGGTAGGAAG TACAAAAAAG TCCGATTTAT
2041 GGCATACACA GATGAAACCT TTAAGACTCG TGAAGCTATT CAGCATGAAT CAGGAATCTT
2101 GGGACCTTTA CTTTATGGGG AAGTTGGAGA CACACTGTTG ATTATATTTA AGAATCAAGC
2161 AAGCAGACCA TATAACATCT ACCCTCACGG AATCACTGAT GTCCGTCCTT TGTATTCAAG
2221 GAGATTACCA AAAGGTGTAA AACATTTGAA GGATTTTCCA ATTCTGCCAG GAGAAATATT
2281 CAAATATAAA TGGACAGTGA CTGTAGAAGA TGGGCCAACT AAATCAGATC CTCGGTGCCT
2341 GACCCGCTAT TACTCTAGTT TCGTTAATAT GGAGAGAGAT CTAGCTTCAG GACTCATTGG
2401 CCCTCTCCTC ATCTGCTACA AAGAATCTGT AGATCAAAGA GGAAACCAGA TAATGTCAGA
2461 CAAGAGGAAT GTCATCCTGT TTTCTGTATT TGATGAGAAC CGAAGCTGGT ACCTCACAGA
2521 GAATATACAA CGCTTTCTCC CCAATCCAGC TGGAGTGCAG CTTGAGGATC CAGAGTTCCA
2581 AGCCTCCAAC ATCATGCACA GCATCAATGG CTATGTTTTT GATAGTTTGC AGTTGTCAGT
2641 TTGTTTGCAT GAGGTGGCAT ACTGGTACAT TCTAAGCATT GGAGCACAGA CTGACTTCCT
2701 TTCTGTCTTC TTCTCTGGAT ATACCTTCAA ACACAAAATG GTCTATGAAG ACACACTCAC
2761 CCTATTCCCA TTCTCAGGAG AAACTGTCTT CATGTCGATG GAAAACCCAG GTCTATGGAT
2821 TCTGGGGTGC CACAACTCAG ACTTTCGGAA CAGAGGCATG ACCGCCTTAC TGAAGGTTTC
2881 TAGTTGTGAC AAGAACACTG GTGATTATTA CGAGGACAGT TATGAAGATA TTTCAGCATA
2941 CTTGCTGAGT AAAAACAATG CCATTGAACC AAGAAGCTTC TCCCAGAATT CAAGACACCC
3001 TAGCACTAGG CAAAAGCAAT TTAATGCCAC CACAATTCCA GAAAATGACA TAGAGAAGAC
3061 TGACCCTTGG TTTGCACACA GAACACCTAT GCCTAAAATA CAAAATGTCT CCTCTAGTGA
3121 TTTGTTGATG CTCTTGCGAC AGAGTCCTAC TCCACATGGG CTATCCTTAT CTGATCTCCA
3181 AGAAGCCAAA TATGAGACTT TTTCTGATGA TCCATCACCT GGAGCAATAG ACAGTAATAA
3241 CAGCCTGTCT GAAATGACAC ACTTCAGGCC ACAGCTCCAT CACAGTGGGG ACATGGTATT
3301 TACCCCTGAG TCAGGCCTCC AATTAAGATT AAATGAGAAA CTGGGGACAA CTGCAGCAAC
3361 AGAGTTGAAG AAACTTGATT TCAAAGTTTC TAGTACATCA AATAATCTGA TTTCAACAAT
```

TABLE 3-continued

Nucleotide Sequence Encoding Full-Length FVIII (SEQ ID NO: 66)*
*The underlined nucleic acids encode a signal peptide.

```
3421 TCCATCAGAC AATTTGGCAG CAGGTACTGA TAATACAAGT TCCTTAGGAC CCCCAAGTAT
3481 GCCAGTTCAT TATGATAGTC AATTAGATAC CACTCTATTT GGCAAAAAGT CATCTCCCCT
3541 TACTGAGTCT GGTGGACCTC TGAGCTTGAG TGAAGAAAAT AATGATTCAA AGTTGTTAGA
3601 ATCAGGTTTA ATGAATAGCC AAGAAAGTTC ATGGGGAAAA ATGTATCGT CAACAGAGAG
3661 TGGTAGGTTA TTTAAAGGGA AAAGAGCTCA TGGACCTGCT TGTTGACTA AGATAATGC
3721 CTTATTCAAA GTTAGCATCT CTTTGTTAAA GACAAACAAA ACTTCCAATA ATTCAGCAAC
3781 TAATAGAAAG ACTCACATTG ATGGCCCATC ATTATTAATT GAGAATAGTC CATCAGTCTG
3841 GCAAAATATA TTAGAAAGTG ACACTGAGTT TAAAAAGTG ACACCTTTGA TTCATGACAG
3901 AATGCTTATG ACAAAAATG CTACAGCTTT GAGGCTAAAT CATATGTCAA ATAAAACTAC
3961 TTCATCAAAA ACATGGAAA TGGTCCAACA GAAAAAGAG GGCCCCATTC ACCAGATGC
4021 ACAAAATCCA GATATGTCGT TCTTTAAGAT GCTATTCTTG CCAGAATCAG CAAGGTGGAT
4081 ACAAGGACT CATGGAAAGA ACTCTCTGAA CTCTGGGCAA GGCCCAGTC CAAAGCAATT
4141 AGTATCCTTA GGACCAGAAA AATCTGTGGA AGGTCAGAAT TTCTTGTCTG AGAAAAACAA
4201 AGTGGTAGTA GGAAAGGGTG AATTTACAAA GGACGTAGGA CTCAAAGAGA TGGTTTTTCC
4261 AAGCAGCAGA AACCTATTTC TTACTAACTT GGATAATTTA CATGAAAATA ATACACACAA
4321 TCAAGAAAAA AAAATTCAGG AAGAAATAGA AAAGAAGGAA ACATTAATCC AAGAGAATGT
4381 AGTTTTGCCT CAGATACATA CAGTGACTGG CACTAAGAAT TTCATGAAGA ACCTTTTCTT
4441 ACTGAGCACT AGGCAAAATG TAGAAGGTTC ATATGACGGG GCATATGCTC CAGTACTTCA
4501 AGATTTTAGG TCATTAAATG ATTCAACAAA TAGAACAAAG AAACACACAG CTCATTTCTC
4561 AAAAAAAGGG GAGGAAGAAA ACTTGGAAGG CTTGGGAAAT CAAACCAAGC AAATTGTAGA
4621 GAAATATGCA TGCACCACAA GGATATCTCC TAATACAAGC CAGCAGAATT TTGTCACGCA
4681 ACGTAGTAAG AGAGCTTTGA ACAATTCAG ACTCCCACTA GAAGAAACAG AACTTGAAAA
4741 AAGGATAATT GTGGATGACA CCTCAACCCA GTGGTCCAAA AACATGAAAC ATTTGACCCC
4801 GAGCACCCTC ACACAGATAG ACTACAATGA GAAGGAGAAA GGGGCCATTA CTCAGTCTCC
4861 CTTATCAGAT TGCCTTACGA GGAGTCATAG CATCCCTCAA GCAAATAGAT CTCCATTACC
4921 CATTGCAAAG GTATCATCAT TTCCATCTAT TAGACCTATA TATCTGACCA GGGTCCTATT
4981 CCAAGACAAC TCTTCTCATC TTCCAGCAGC ATCTTATAGA AAGAAAGATT CTGGGGTCCA
5041 AGAAAGCAGT CATTTCTTAC AAGGAGCCAA AAAAATAAC CTTTCTTTAG CCATTCTAAC
5101 CTTGGAGATG ACTGGTGATC AAAGAGAGGT TGGCTCCCTG GGGACAAGTG CCACAAATTC
5161 AGTCACATAC AAGAAAGTTG AGAACACTGT TCTCCCGAAA CCAGACTTGC CCAAAACATC
5221 TGGCAAAGTT GAATTGCTTC CAAAAGTTCA CATTTATCAG AAGGACCTAT TCCCTACGGA
5281 AACTAGCAAT GGGTCTCCTG GCCATCTGGA TCTCGTGGAA GGGAGCCTTC TTCAGGGAAC
5341 AGAGGGAGCG ATTAAGTGGA ATGAAGCAAA CAGACCTGGA AAAGTTCCCT TTCTGAGAGT
5401 AGCAACAGAA AGCTCTGCAA AGACTCCCTC CAAGCTATTG GATCCTCTTG CTTGGGATAA
5461 CCACTATGGT ACTCAGATAC CAAAAGAAGA GTGGAAATCC AAGAGAAGT CACCAGAAAA
5521 AACAGCTTTT AAGAAAAAGG ATACCATTTT GTCCCTGAAC GCTTGTGAAA GCAATCATGC
5581 AATAGCAGCA ATAAATGAGG GACAAAATAA GCCCGAAATA GAAGTCACCT GGGCAAAGCA
```

TABLE 3-continued

Nucleotide Sequence Encoding Full-Length FVIII (SEQ ID NO: 66)*
*The underlined nucleic acids encode a signal peptide.

```
5641 AGGTAGGACT GAAAGGCTGT GCTCTCAAAA CCCACCAGTC TTGAAACGCC ATCAACGGGA
5701 AATAACTCGT ACTACTCTTC AGTCAGATCA AGAGGAAATT GACTATGATG ATACCATATC
5761 AGTTGAAATG AAGAAGGAAG ATTTTGACAT TTATGATGAG GATGAAAATC AGAGCCCCCG
5821 CAGCTTTCAA AAGAAAACAC GACACTATTT TATTGCTGCA GTGGAGAGGC TCTGGGATTA
5881 TGGGATGAGT AGCTCCCCAC ATGTTCTAAG AAACAGGGCT CAGAGTGGCA GTGTCCCTCA
5941 GTTCAAGAAA GTTGTTTTCC AGGAATTTAC TGATGGCTCC TTTACTCAGC CCTTATACCG
6001 TGGAGAACTA AATGAACATT TGGGACTCCT GGGGCCATAT ATAAGAGCAG AAGTTGAAGA
6061 TAATATCATG GTAACTTTCA GAAATCAGGC CTCTCGTCCC TATTCCTTCT ATTCTAGCCT
6121 TATTTCTTAT GAGGAAGATC AGAGGCAAGG AGCAGAACCT AGAAAAAACT TTGTCAAGCC
6181 TAATGAAACC AAAACTTACT TTTGGAAAGT GCAACATCAT ATGGCACCCA CTAAAGATGA
6241 GTTTGACTGC AAAGCCTGGG CTTATTTCTC TGATGTTGAC CTGGAAAAAG ATGTGCACTC
6301 AGGCCTGATT GGACCCCTTC TGGTCTGCCA CACTAACACA CTGAACCCTG CTCATGGGAG
6361 ACAAGTGACA GTACAGGAAT TTGCTCTGTT TTTCACCATC TTTGATGAGA CCAAAAGCTG
6421 GTACTTCACT GAAAATATGG AAAGAAACTG CAGGGCTCCC TGCAATATCC AGATGGAAGA
6481 TCCCACTTTT AAAGAGAATT ATCGCTTCCA TGCAATCAAT GGCTACATAA TGGATACACT
6541 ACCTGGCTTA GTAATGGCTC AGGATCAAAG GATTCGATGG TATCTGCTCA GCATGGGCAG
6601 CAATGAAAAC ATCCATTCTA TTCATTTCAG TGGACATGTG TTCACTGTAC GAAAAAAAGA
6661 GGAGTATAAA ATGGCACTGT ACAATCTCTA TCCAGGTGTT TTTGAGACAG TGGAAATGTT
6721 ACCATCCAAA GCTGGAATTT GGCGGGTGGA ATGCCTTATT GGCGAGCATC TACATGCTGG
6781 GATGAGCACA CTTTTTCTGG TGTACAGCAA TAAGTGTCAG ACTCCCCTGG GAATGGCTTC
6841 TGGACACATT AGAGATTTTC AGATTACAGC TTCAGGACAA TATGGACAGT GGGCCCCAAA
6901 GCTGGCCAGA CTTCATTATT CCGGATCAAT CAATGCCTGG AGCACCAAGG AGCCCTTTTC
6961 TTGGATCAAG GTGGATCTGT TGGCACCAAT GATTATTCAC GGCATCAAGA CCCAGGGTGC
7021 CCGTCAGAAG TTCTCCAGCC TCTACATCTC TCAGTTTATC ATCATGTATA GTCTTGATGG
7081 GAAGAAGTGG CAGACTTATC GAGGAAATTC CACTGGAACC TTAATGGTCT TCTTTGGCAA
7141 TGTGGATTCA TCTGGGATAA AACACAATAT TTTTAACCCT CCAATTATTG CTCGATACAT
7201 CCGTTTGCAC CCAACTCATT ATAGCATTCG CAGCACTCTT CGCATGGAGT TGATGGGCTG
7261 TGATTTAAAT AGTTGCAGCA TGCCATTGGG AATGGAGAGT AAAGCAATAT CAGATGCACA
7321 GATTACTGCT TCATCCTACT TTACCAATAT GTTTGCCACC TGGTCTCCTT CAAAAGCTCG
7381 ACTTCACCTC CAAGGGAGGA GTAATGCCTG GAGACCTCAG GTGAATAATC CAAAAGAGTG
7441 GCTGCAAGTG GACTTCCAGA AGACAATGAA AGTCACAGGA GTAACTACTC AGGGAGTAAA
7501 ATCTCTGCTT ACCAGCATGT ATGTGAAGGA GTTCCTCATC TCCAGCAGTC AAGATGGCCA
7561 TCAGTGGACT CTCTTTTTTC AGAATGGCAA AGTAAAGGTT TTTCAGGGAA ATCAAGACTC
7621 CTTCACACCT GTGGTGAACT CTCTAGACCC ACCGTTACTG ACTCGCTACC TTCGAATTCA
7681 CCCCCAGAGT TGGGTGCACC AGATTGCCCT GAGGATGGAG GTTCTGGGCT GCGAGGCACA
7741 GGACCTCTAC
```

FVIII polypeptides include full-length FVIII, full-length FVIII minus Met at the N-terminus, mature FVIII (minus the signal sequence), mature FVIII with an additional Met at the N-terminus, and/or FVIII with a full or partial deletion of the B domain. In certain embodiments, FVIII variants include B domain deletions, whether partial or full deletions.

The sequence of native mature human FVIII polypeptide is presented as SEQ ID NO: 65. A native FVIII polypeptide has the following formula: A1-a1-A2-a2-B-a3-A3-C1-C2, where A1, A2, and A3 are the structurally-related "A domains," B is the "B domain," C1 and C2 are the structurally-related "C domains," and a1, a2 and a3 are acidic spacer regions. Referring to the primary amino acid sequence position in SEQ ID NO:65, the A1 domain of human FVIII extends from Ala1 to about Arg336, the a1 spacer region extends from about Met337 to about Val374, the A2 domain extends from about Ala375 to about Tyr719, the a2 spacer region extends from about Glu720 to about Arg740, the B domain extends from about Ser741 to about Arg 1648, the a3 spacer region extends from about Glu1649 to about Arg1689, the A3 domain extends from about Ser1690 to about Leu2025, the C1 domain extends from about Gly2026 to about Asn2072, and the C2 domain extends from about Ser2073 to Tyr2332. Other than specific proteolytic cleavage sites, designation of the locations of the boundaries between the domains and regions of FVIII can vary in different literature references. The boundaries noted herein are therefore designated as approximate by use of the term "about."

The human FVIII gene was isolated and expressed in mammalian cells (Toole, J. J., et al., Nature 312:342-347 (1984); Gitschier, J., et al., Nature 312:326-330 (1984); Wood, W. I., et al., Nature 312:330-337 (1984); Vehar, G. A., et al., Nature 312:337-342 (1984); WO 87/04187; WO 88/08035; WO 88/03558; and U.S. Pat. No. 4,757,006). The FVIII amino acid sequence was deduced from cDNA as shown in U.S. Pat. No. 4,965,199. In addition, partially or fully B-domain deleted FVIII is shown in U.S. Pat. Nos. 4,994,371 and 4,868,112. In some embodiments, the human FVIII B-domain is replaced with the human Factor V B-domain as shown in U.S. Pat. No. 5,004,803. The cDNA sequence encoding human Factor VIII and amino acid sequence are shown in SEQ ID NOs: 1 and 2, respectively, of US Application Publ. No. 2005/0100990.

The porcine FVIII sequence is published in Toole, J. J., et al., Proc. Natl. Acad. Sci. USA 83:5939-5942 (1986). Further, the complete porcine cDNA sequence obtained from PCR amplification of FVIII sequences from a pig spleen cDNA library has been reported in Healey, J. F., et al., Blood 88:4209-4214 (1996). Hybrid human/porcine FVIII having substitutions of all domains, all subunits, and specific amino acid sequences were disclosed in U.S. Pat. No. 5,364,771 by Lollar and Runge, and in WO 93/20093. More recently, the nucleotide and corresponding amino acid sequences of the A1 and A2 domains of porcine FVIII and a chimeric FVIII with porcine A1 and/or A2 domains substituted for the corresponding human domains were reported in WO 94/11503. U.S. Pat. No. 5,859,204, Lollar, J. S., also discloses the porcine cDNA and deduced amino acid sequences. U.S. Pat. No. 6,458,563 discloses a B-domain-deleted porcine FVIII.

U.S. Pat. No. 5,859,204 to Lollar, J. S. reports functional mutants of FVIII having reduced antigenicity and reduced immunoreactivity. U.S. Pat. No. 6,376,463 to Lollar, J. S. also reports mutants of FVIII having reduced immunoreactivity. US Appl. Publ. No. 2005/0100990 to Saenko et al. reports functional mutations in the A2 domain of FVIII.

In some embodiments, the FVIII polypeptide (or FVIII portion of a chimeric polypeptide) can be at least 50%, 60%, 70%, 80%, 90%, 95%, 96%, 97%, 98%, 99%, or 100% identical to a FVIII amino acid sequence of amino acids 1 to 1438 of SEQ ID NO: 67 or amino acids 1 to 2332 of SEQ ID NO: 65 (without a signal sequence) or a FVIII amino acid sequence of amino acids 1 to 19 of SEQ ID NO: 64 and 1 to 1438 of SEQ ID NO: 67 or amino acids 1 to 19 of SEQ ID NO: 64 and amino acids 1 to 2332 of SEQ ID NO: 65 (with a signal sequence), wherein the FVIII has a clotting activity, e.g., activates Factor IX as a cofactor to convert Factor X to activated Factor X. The FVIII polypeptide (or FVIII portion of a chimeric polypeptide) can be identical to a FVIII amino acid sequence of amino acids 1 to 1438 of SEQ ID NO: 67 or amino acids 1 to 2332 of SEQ ID NO: 65 (without a signal sequence). The FVIII polypeptide can further comprise a signal sequence.

The "B-domain" of FVIII, as used herein, is the same as the B-domain known in the art that is defined by internal amino acid sequence identity and sites of proteolytic cleavage, e.g., residues Ser741-Arg1648 of full-length human FVIII. The other human FVIII domains are defined by the following amino acid residues: A1, residues Ala1-Arg372; A2, residues Ser373-Arg740; A3, residues Ser1690-Asn2019; C1, residues Lys2020-Asn2172; C2, residues Ser2173-Tyr2332. The A3-C1-C2 sequence includes residues Ser1690-Tyr2332. The remaining sequence, residues Glu1649-Arg1689, is usually referred to as the a3 acidic region. The locations of the boundaries for all of the domains, including the B-domains, for porcine, mouse and canine FVIII are also known in the art. In some embodiments, the B domain of FVIII is deleted ("B-domain-deleted factor VIII" or "BDD FVIII"). An example of a BDD FVIII is REFACTO® (recombinant BDD FVIII), which has the same sequence as the Factor VIII portion of the sequence in Table 4. (BDD FVIII heavy chain is double underlined; B domain is italicized; and BDD FVIII light chain is in plain text). In some embodiments, the B domain FVIII has a deletion of the full B domain except 5 amino acids, as shown in Table 5 (SEQ ID NO: 68) (B domain is italicized).

TABLE 4

Amino Acid Sequence of B-domain Deleted Factor VIII (B-domain deletion except 14 amino acid residues) (SEQ ID NO: 67)

ATRRYYLGAVELSWDYMQSDLGELPVDARFPPRVPKSFPFNTSVVYKKTL

FVEFTDHLFNIAKPRPPWMGLLGPTIQAEVYDTVVITLKNMASHPVSLHA

VGVSYWKASEGAEYDDQTSQREKEDDKVFPGGSHTYVWQVLKENGPMASD

PLCLTYSYLSHVDLVKDLNSGLIGALLVCREGSLAKEKTQTLHKFILLFA

VFDEGKSWHSETKNSLMQDRDAASARAWPKMHTVNGYVNRSLPGLIGCHR

KSVYWHVIGMGTTPEVHSIFLEGHTFLVRNHRQASLEISPITFLTAQTLL

MDLGQFLLFCHISSHQHDGMEAYVKVDSCPEEPQLRMKNNEEAEDYDDDL

TDSEMDVVRFDDDNSPSFIQIRSVAKKHPKTWVHYIAAEEEDWDYAPLVL

APDDRSYKSQYLNNGPQRIGRKYKKVRFMAYTDETFKTREAIQHESGILG

PLLYGEVGDTLLIIFKNQASRPYNIYPHGITDVRPLYSRRLPKGVKHLKD

FPILPGEIFKYKWTVTVEDGPTKSDPRCLTRYYSSFVNMERDLASGLIGP

LLICYKESVDQRGNQIMSDKRNVILFSVFDENRSWYLTENIQRFLPNPAG

VQLEDPEFQASNIMHSINGYVFDSLQLSVCLHEVAYWYILSIGAQTDFLS

TABLE 4-continued

Amino Acid Sequence of B-domain Deleted Factor VIII (B-domain deletion except 14 amino acid residues) (SEQ ID NO: 67)

VFFSGYTFKHKMVYEDTLTLFPFSGETVFMSMENPGLWILGCHNSDFRNR

GMTALLKVSSCDKNTGDYYEDSYEDISAYLLSKNNAIEPR*SFSQNPPVLK*

*RHQ*REITRTTLQSDQEEIDYDDTISVEMKKEDFDIYDEDENQSPRSFQKK

TRHYFIAAVERLWDYGMSSSPHVLRNRAQSGSVPQFKKVVFQEFTDGSFT

QPLYRGELNEHLGLLGPYIRAEVEDNIMVTFRNQASRPYSFYSSLISYEE

DQRQGAEPRKNFVKPNETKTYFWKVQHHMAPTKDEFDCKAWAYFSDVDLE

KDVHSGLIGPLLVCHTNTLNPAHGRQVTVQEFALFFTIFDETKSWYFTEN

MERNCRAPCNIQMEDPTFKENYRFHAINGYIMDTLPGLVMAQDQRIRWYL

LSMGSNENIHSIHFSGHVFTVRKKEEYKMALYNLYPGVFETVEMLPSKAG

IWRVECLIGEHLHAGMSTLFLVYSNKCQTPLGMASGHIRDFQITASGQYG

QWAPKLARLHYSGSINAWSTKEPFSWIKVDLLAPMIIHGIKTQGARQKFS

SLYISQFIIMYSLDGKKWQTYRGNSTGTLMVFFGNVDSSGIKHNIFNPPI

IARYIRLHPTHYSIRSTLRMELMGCDLNSCSMPLGMESKAISDAQITASS

YFTNMFATWSPSKARLHLQGRSNAWRPQVNNPKEWLQVDFQKTMKVTGVT

TQGVKSLLTSMYVKEFLISSSQDGHQWTLFFQNGKVKVFQGNQDSFTPVV

NSLDPPLLTRYLRIHPQSWVHQIALRMEVLGCEAQDLY

TABLE 5

Amino Acid Sequence of B-domain Deleted Factor VIII (B-domain deletion except 5 amino acid residues) (SEQ ID NO: 68)

ATRRYYLGAVELSWDYMQSDLGELPVDARFPPRVPKSFPFNTSVVYKKTL

FVEFTDHLFNIAKPRPPWMGLLGPTIQAEVYDTVVITLKNMASHPVSLHA

VGVSYWKASEGAEYDDQTSQREKEDDKVFPGGSHTYVWQVLKENGPMASD

PLCLTYSYLSHVDLVKDLNSGLIGALLVCREGSLAKEKTQTLHKFILLFA

VFDEGKSWHSETKNSLMQDRDAASARAWPKMHTVNGYVNRSLPGLIGCHR

KSVYWHVIGMGTTPEVHSIFLEGHTFLVRNHRQASLEISPITFLTAQTLL

MDLGQFLLFCHISSHQHDGMEAYVKVDSCPEEPQLRMKNNEEAEDYDDDL

TDSEMDVVRFDDDNSPSFIQIRSVAKKHPKTWVHYIAAEEEDWDYAPLVL

APDDRSYKSQYLNNGPQRIGRKYKKVRFMAYTDETFKTREAIQHESGILG

PLLYGEVGDTLLIIFKNQASRPYNIYPHGITDVRPLYSRRLPKGVKHLKD

FPILPGEIFKYKWTVTVEDGPTKSDPRCLTRYYSSFVNMERDLASGLIGP

LLICYKESVDQRGNQIMSDKRNVILFSVFDENRSWYLTENIQRFLPNPAG

VQLEDPEFQASNIMHSINGYVFDSLQLSVCLHEVAYWYILSIGAQTDFLS

VFFSGYTFKHKMVYEDTLTLFPFSGETVFMSMENPGLWILGCHNSDFRNR

GMTALLKVSSCDKNTGDYYEDSYEDISAYLLSKNNAIEPR*SFSQ*NEITRT

TLQSDQEEIDYDDTISVEMKKEDFDIYDEDENQSPRSFQKKTRHYFIAAV

ERLWDYGMSSSPHVLRNRAQSGSVPQFKKVVFQEFTDGSFTQPLYRGELN

TABLE 5-continued

Amino Acid Sequence of B-domain Deleted Factor VIII (B-domain deletion except 5 amino acid residues) (SEQ ID NO: 68)

EHLGLLGPYIRAEVEDNIMVTFRNQASRPYSFYSSLISYEEDQRQGAEPR

KNFVKPNETKTYFWKVQHHMAPTKDEFDCKAWAYFSDVDLEKDVHSGLIG

PLLVCHTNTLNPAHGRQVTVQEFALFFTIFDETKSWYFTENMERNCRAPC

NIQMEDPTFKENYRFHAINGYIMDTLPGLVMAQDQRIRWYLLSMGSNENI

HSIHFSGHVFTVRKKEEYKMALYNLYPGVFETVEMLPSKAGIWRVECLIG

EHLHAGMSTLFLVYSNKCQTPLGMASGHIRDFQITASGQYGQWAPKLARL

HYSGSINAWSTKEPFSWIKVDLLAPMIIHGIKTQGARQKFSSLYISQFII

MYSLDGKKWQTYRGNSTGTLMVFFGNVDSSGIKHNIFNPPIIARYIRLHP

THYSIRSTLRMELMGCDLNSCSMPLGMESKAISDAQITASSYFTNMFATW

SPSKARLHLQGRSNAWRPQVNNPKEWLQVDFQKTMKVTGVTTQGVKSLLT

SMYVKEFLISSSQDGHQWTLFFQNGKVKVFQGNQDSFTPVVNSLDPPLLT

RYLRIHPQSWVHQIALRMEVLGCEAQDLY

A "B-domain-deleted FVIII" can have the full or partial deletions disclosed in U.S. Pat. Nos. 6,316,226, 6,346,513, 7,041,635, 5,789,203, 6,060,447, 5,595,886, 6,228,620, 5,972,885, 6,048,720, 5,543,502, 5,610,278, 5,171,844, 5,112,950, 4,868,112, and 6,458,563, U.S. Publ. Nos. US 2017/0073393 A1 and US 2012/308641 A1, and Intl Publ. Nos. WO 2011/041770 A1, WO 2015/106052 A1 (PCT/US2015/010738), and WO 2016/025764. In some embodiments, a B-domain-deleted FVIII sequence used in the methods of the present disclosure comprises any one of the deletions disclosed at col. 4, line 4 to col. 5, line 28 and Examples 1-5 of U.S. Pat. No. 6,316,226 (also in U.S. Pat. No. 6,346,513). In other embodiments, a B-domain deleted Factor VIII is the 5743/Q1638 B-domain deleted Factor VIII (SQ BDD FVIII) (e.g., Factor VIII having a deletion from amino acid 744 to amino acid 1637, e.g., Factor VIII having amino acids 1-743 and amino acids 1638-2332 of mature FVIII). In some embodiments, a B-domain-deleted FVIII used in the methods of the present disclosure has a deletion disclosed at col. 2, lines 26-51 and examples 5-8 of U.S. Pat. No. 5,789,203 (also U.S. Pat. Nos. 6,060,447, 5,595,886, and 6,228,620). In some embodiments, a B-domain-deleted Factor VIII has a deletion described in col. 1, lines 25 to col. 2, line 40 of U.S. Pat. No. 5,972,885; col. 6, lines 1-22 and example 1 of U.S. Pat. No. 6,048,720; col. 2, lines 17-46 of U.S. Pat. No. 5,543,502; col. 4, line 22 to col. 5, line 36 of U.S. Pat. No. 5,171,844; col. 2, lines 55-68, FIG. 2, and example 1 of U.S. Pat. No. 5,112,950; col. 2, line 2 to col. 19, line 21 and table 2 of U.S. Pat. No. 4,868,112; col. 2, line 1 to col. 3, line 19, col. 3, line 40 to col. 4, line 67, col. 7, line 43 to col. 8, line 26, and col. 11, line 5 to col. 13, line 39 of U.S. Pat. No. 7,041,635; or col. 4, lines 25-53, of U.S. Pat. No. 6,458,563. In some embodiments, a B-domain-deleted FVIII polypeptide has a deletion of most of the B domain, but still contains amino-terminal sequences of the B domain that are essential for in vivo proteolytic processing of the primary translation product into two polypeptide chains, as disclosed in WO 91/09122. In some embodiments, a B-domain-deleted FVIII polypeptide is constructed with a deletion of amino acids 747-1638, i.e., virtually a complete deletion of the B domain. Hoeben R. C., et al. J. Biol. Chem. 265 (13): 7318-7323 (1990). A B-domain-deleted Factor VIII polypeptide can also contain a deletion of amino acids 771-1666 or amino acids 868-1562 of FVIII. Meulien P., et al. Protein Eng. 2(4): 301-6 (1988). Additional B domain deletions that are part of the disclosure include: deletion of amino acids 982 through 1562 or 760 through 1639 (Toole et al., Proc. Natl. Acad. Sci. U.S.A. (1986) 83, 5939-5942)), 797 through 1562 (Eaton, et al. Biochemistry (1986) 25:8343-8347)), 741 through 1646 (Kaufman (PCT published application No. WO 87/04187)), 747-1560 (Sarver, et al., DNA (1987) 6:553-564)), 741 through 1648 (Pasek (PCT application No. 88/00831)), or 816 through 1598 or 741 through 1648 (Lagner (Behring Inst. Mitt. (1988) No 82:16-25, EP 295597)). In particular embodiments, the B-domain-deleted FVIII polypeptide comprises a deletion of amino acid residues 746 to 1648 of mature FVIII (corresponding to a deletion of 765 to 1665 of full length FVIII). In other embodiments, the B-domain-deleted FVIII polypeptide comprises a deletion of amino acid residues 745 to 1648 of mature FVIII (corresponding to a deletion of 764 to 1665 of full length FVIII).

In other embodiments, BDD FVIII includes a FVIII polypeptide containing fragments of the B-domain that retain one or more N-linked glycosylation sites, e.g., residues 757, 784, 828, 900, 963, or optionally 943, which correspond to the amino acid sequence of the full-length FVIII sequence. Examples of the B-domain fragments include 226 amino acids or 163 amino acids of the B-domain as disclosed in Miao, H. Z., et al., Blood 103(a): 3412-3419 (2004), Kasuda, A, et al., J. Thromb. Haemost. 6: 1352-1359 (2008), and Pipe, S. W., et al., J. Thromb. Haemost. 9: 2235-2242 (2011) (i.e., the first 226 amino acids or 163 amino acids of the B domain are retained). In still other embodiments, BDD FVIII further comprises a point mutation at residue 309 (from Phe to Ser) to improve expression of the BDD FVIII polypeptide. See Miao, H. Z., et al., Blood 103(a): 3412-3419 (2004). In still other embodiments, the BDD FVIII includes a FVIII polypeptide containing a portion of the B-domain, but not containing one or more furin cleavage sites (e.g., Arg1313 and Arg 1648). See Pipe, S. W., et al., J. Thromb. Haemost. 9: 2235-2242 (2011). In some embodiments, the BDD FVIII comprises single chain FVIII that contains a deletion in amino acids 765 to 1652 corresponding to the mature full length FVIII (also known as rFVIII-SingleChain and AFSTYLA®). See U.S. Pat. No. 7,041,635. Each of the foregoing deletions can be made in any FVIII sequence.

In some embodiments, the FVIII has a partial B-domain. In some embodiments, the FVIII polypeptide with a partial B-domain is FVIII198. FVIII198 is a partial B-domain containing single chain FVIIIFc molecule-226N6. Number 226 represents the N-terminus 226 amino acid of the FVIII B-domain, and N6 represents six N-glycosylation sites in the B-domain.

In certain embodiments, the FVIII polypeptide is selected from a FVIII polypeptide disclosed in Publication Nos. WO 2017/117630 A1, WO 2018/087271 A1, U.S. Pat. No. 9,878, 017 B2, U.S. Pat. No. 8,575,104 B2, U.S. Pat. No. 8,754,194 B2, U.S. Pat. No. 7,939,632 B2, US 2018/0161402 A1, U.S. Pat. No. 9,956,269 B2, U.S. Pat. No. 9,107,902 B2, US 2017/209546 A1, In some embodiments, FVIII is cleaved right after Arginine at amino acid 1648 (in full-length Factor VIII or SEQ ID NO: 65), amino acid 754 (in the 5743/Q1638 B-domain deleted Factor VIII or SEQ ID NO: 67), or the corresponding Arginine residue (in other variants), thereby resulting in a heavy chain and a light chain. In other embodiments, a FVIII polypeptide comprises a heavy chain and a light chain, which are linked or associated by a metal ion-mediated non-covalent bond.

In other embodiments, FVIII is a single chain FVIII that has not been cleaved right after Arginine at amino acid 1648 (in full-length FVIII or SEQ ID NO: 65), amino acid 754 (in the 5743/Q1638 B-domain-deleted FVIII or SEQ ID NO: 67), or the corresponding Arginine residue (in other variants). A single chain FVIII can comprise one or more amino acid substitutions. In some embodiments, the amino acid substitution is at a residue corresponding to residue 1648, residue 1645, or both of full-length mature Factor VIII polypeptide (SEQ ID NO: 65) or residue 754, residue 751, or both of SQ BDD Factor VIII (SEQ ID NO: 67). The amino acid substitution can be any amino acids other than Arginine, e.g., isoleucine, leucine, lysine, methionine, phenylalanine, threonine, tryptophan, valine, alanine, asparagine, aspartic acid, cysteine, glutamic acid, glutamine, glycine, proline, selenocysteine, serine, tyrosine, histidine, ornithine, pyrrolysine, or taurine.

FVIII can further be cleaved by thrombin and then activated as FVIIIa, serving as a cofactor for activated Factor IX (FIXa). And the activated FIX together with activated FVIII forms a Xase complex and converts Factor X to activated Factor X (FXa). For activation, FVIII is cleaved by thrombin after three Arginine residues, at amino acids 372, 740, and 1689 (corresponding to amino acids 372, 740, and 795 in the B-domain deleted FVIII sequence), the cleavage generating FVIIIa having the 50 kDa A1, 43 kDa A2, and 73 kDa A3-C1-C2 chains. In some embodiments, the FVIII polypeptide useful for the present disclosure is non-active FVIII. In other embodiments, the FVIII polypeptide is an activated FVIII.

The protein having FVIII polypeptide linked to or associated with the VWF protein can comprise a sequence at least 50%, 60%, 70%, 80%, 90%, 95%, 96%, 97%, 98%, 99%, or 100% identical to SEQ ID NO: 65 or 67, wherein the sequence has the FVIII clotting activity, e.g., activating Factor IX as a cofactor to convert Factor X to activated Factor X (FXa).

"Hybrid" or "chimeric" polypeptides and proteins, as used herein, includes a combination of a first polypeptide and a second polypeptide. In some embodiments, the hybrid or chimeric polypeptide comprises a single polypeptide chain, e.g., a chimeric polypeptide comprising a FVIII polypeptide and an XTEN. See, e.g., US 2015/0158929 A1, which is incorporated by reference herein in its entirety. In some embodiments, the hybrid or chimeric polypeptide comprises a combination of a first polypeptide chain, e.g., a VWF fragment fused to an XTEN sequence and a first Ig constant region or a portion thereof, with a second polypeptide chain, e.g., a FVIII polypeptide fused to a second Ig constant region or a portion thereof, thereby forming a heterodimer. See, e.g., US 2015/0266943 A1, US 2016/0251408 A1, US 2017/0073393 A1, each of which is incorporated by reference herein in its entirety. In some embodiments, the first polypeptide and the second polypeptide in a hybrid are associated with each other via protein-protein interactions, such as charge-charge or hydrophobic interactions. In other embodiments, a first polypeptide comprises a VWF protein-XTEN-Fc fusion protein, and a second polypeptide comprises FVIII-Fc fusion protein, making the hybrid a heterodimer, wherein the XTEN contains less than 288 amino acids. In other embodiments, the first polypeptide comprises a VWF protein-XTEN-Fc fusion protein, and the second polypeptide comprises FVIII(X)-Fc fusion protein, making the hybrid a heterodimer, wherein the XTEN contains less than 288 amino acids. The first polypeptide and the second polypeptide can be associated through a covalent bond, e.g., a disulfide bond, between the first Fc region and the second Fc region. The first polypeptide and the second polypeptide can further be associated with each other by binding between the VWF fragment and the FVIII polypeptide.

In certain embodiments, the chimeric polypeptide disclosed herein comprises a FVIII protein comprising a first FVIII polypeptide fragment, an XTEN sequence, a second FVIII polypeptide fragment, and a Fc region. In some embodiments, the FVIII protein comprises, as ordered from N-terminal to C-terminal, a first FVIII polypeptide fragment, fused to an XTEN sequence, fused to a second FVIII polypeptide fragment, fused to a Fc region. In a specific embodiment, the FVIII protein comprises a first FVIII polypeptide fragment comprising the amino acid sequence of SEQ ID NO: 215, an XTEN sequence comprising the amino acid sequence of SEQ ID NO: 8, a second FVIII polypeptide comprising the amino acid sequence of SEQ ID NO: 216, and/or a first Fc region comprising the amino acid sequence of SEQ ID NO: 217.

In one specific embodiment, the chimeric polypeptide is rFVIIIFc-VWF-XTEN and comprises a FVIII protein comprising the amino acid sequence of SEQ ID NO: 201. In another specific embodiment, rFVIIIFc-VWF-XTEN comprises the amino acid sequence of SEQ ID NO: 207.

In some embodiments, the FVIII protein further comprises a FVIII signal peptide sequence. In one specific embodiment, the FVIII protein comprises a FVIII signal peptide comprising the amino acid sequence of SEQ ID NO: 64, a first FVIII polypeptide fragment comprising the amino acid sequence of SEQ ID NO: 215, an XTEN sequence comprising the amino acid sequence of SEQ ID NO: 8, a second FVIII polypeptide comprising the amino acid sequence of SEQ ID NO: 216, and/or a first Fc region comprising the amino acid sequence of SEQ ID NO: 217.

In one specific embodiment, the chimeric polypeptide is rFVIIIFc-VWF-XTEN and comprises a FVIII protein comprising the amino acid sequence of SEQ ID NO: 203. In another specific embodiment, rFVIIIFc-VWF-XTEN comprises a FVIII protein encoded by the nucleic acid sequence of SEQ ID NO: 204 or a fragment thereof. Additional exemplary polypeptide sequences relating to the FVIII proteins of the chimeric polypeptides disclosed herein are provided in Tables 18-19.

A great many functional FVIII variants are known, as is discussed above and below. In addition, hundreds of non-functional mutations in FVIII have been identified in hemophilia patients, and it has been determined that the effect of these mutations on FVIII function is due more to where they lie within the 3-dimensional structure of FVIII than on the nature of the substitution (Cutler et al., Hum. Mutat. 19:274-8 (2002)), incorporated herein by reference in its entirety. In addition, comparisons between FVIII from humans and other species have identified conserved residues that are likely to be required for function (Cameron et al., Thromb. Haemost. 79:317-22 (1998); U.S. Pat. No. 6,251,632), incorporated herein by reference in its entirety.

III.B. Von Willebrand Factor (VWF) Fragments

VWF (also known as F8VWF) is a large multimeric glycoprotein present in blood plasma and produced constitutively in endothelium (in the Weibel-Palade bodies), megakaryocytes (α-granules of platelets), and subendothelian connective tissue. The basic VWF monomer is a 2813 amino acid protein. Every monomer contains a number of specific domains with a specific function, the D'/D3 domain (which binds to Factor VIII), the A1 domain (which binds to platelet GPIb-receptor, heparin, and/or possibly collagen), the A3 domain (which binds to collagen), the C1 domain (in which the RGD domain binds to platelet integrin αIIbβ3 when this is activated), and the "cysteine knot" domain at the C-terminal end of the protein (which VWF shares with platelet-derived growth factor (PDGF), transforming growth factor-β (TGFβ) and β-human chorionic gonadotropin (βHCG)).

The term "a VWF fragment" as used herein includes, but is not limited to, functional VWF fragments comprising a D' domain and a D3 domain, which are capable of inhibiting binding of endogenous VWF to FVIII. In some embodiments, the VWF fragment binds to the FVIII protein. In other embodiments, the VWF fragment blocks the VWF binding site on the FVIII protein, thereby inhibiting interaction of the FVIII protein with endogenous VWF. In other embodiments, the VWF fragment blocks the binding of FVIII to endogenous VWF, thereby preventing clearance of the FVIII protein through a VWF-clearance pathway. The VWF fragments include derivatives, variants, mutants, or analogues that retain these activities of VWF.

The 2813 monomer amino acid sequence for human VWF is reported as Accession Number NP000543.2 in Genbank. The nucleotide sequence encoding the human VWF is reported as Accession Number NM000552.3 in Genbank. A nucleotide sequence of human VWF is designated as SEQ ID NO: 20. SEQ ID NO: 21 is the amino acid sequence of full-length VWF. Each domain of VWF is listed in Table 6.

TABLE 6

VWF Sequences (human)

| VWF domains | Amino acid Sequence | |
|---|---|---|
| VWF Signal Peptide SEQ ID NO: 208 (Amino acids 1 to 22 of SEQ ID NO: 21) | 1 | MIPARFAGVL LALALILPGT LC 22 |
| VWF D1D2 Domain SEQ ID NO: 209 (Amino acids | 23 | AEGTRGRS STARCSLFGS DFVNTFDGSM |
| | 51 | YSFAGYCSYL LAGGCQKRSF SIIGDFQNGK RVSLSVYLGE FFDIHLFVNG |
| | 101 | TVTQGDQRVS MPYASKGLYL ETEAGYYKLS GEAYGFVARI DGSGNFQVLL |
| | 151 | SDRYFNKTCG LCGNFNIFAE DDFMTQEGTL TSDPYDFANS WALSSGEQWC |
| | 201 | ERASPPSSSC NISSGEMQKG LWEQCQLLKS TSVFARCHPL VDPEPFVALC |

TABLE 6-continued

VWF Sequences (human)

| VWF domains | Amino acid Sequence |
|---|---|
| 23 to 763 of SEQ ID NO: 21) | 251 EKTLCECAGG LECACPALLE YARTCAQEGM VLYGWTDHSA CSPVCPAGME<br>301 YRQCVSPCAR TCQSLHINEM CQERCVDGCS CPEGQLLDEG LCVESTECPC<br>351 VHSGKRYPPG TSLSRDCNTC ICRNSQWICS NEECPGECLV TGQSHFKSFD<br>401 NRYFTFSGIC QYLLARDCQD HSFSIVIETV QCADDRDAVC TRSVTVRLPG<br>451 LHNSLVKLKH GAGVAMDGQD IQLPLLKGDL RIQHTVTASV RLSYGEDLQM<br>501 DWDGRGRLLV KLSPVYAGKT CGLCGNYNGN QGDDFLTPSG LAEPRVEDFG<br>551 NAWKLHGDCQ DLQKQHSDPC ALNPRMTRFS EEACAVLTSP TFEACHRAVS<br>601 PLPYLRNCRY DVCSCSDGRE CLCGALASYA AACAGRGVRV AWREPGRCEL<br>651 NCPKGQVYLQ CGTPCNLTCR SLSYPDEECN EACLEGCFCP PGLYMDERGD<br>701 CVPKAQCPCY YDGEIFQPED IFSDHHTMCY CEDGFMHCTM SGVPGSLLPD<br>751 AVLSSPLSHR SKR 763 |
| VWF D' Domain SEQ ID NO: 210 (Amino acids 764 to 866 of SEQ ID NO: 21) | 764 SLSCRPP MVKLVCPADN LRAEGLECTK TCQNYDLECM<br>801 SMGCVSGCLC PPGMVRHENR CVALERCPCF HQGKEYAPGE TVKIGCNTCV<br>851 CRDRKWNCTD HVCDAT 866 |
| VWF D3 Domain SEQ ID NO: 211 (Amino acids 867 to 1240 of SEQ ID NO: 21) | 867 CSTI GMAHYLTFDG LKYLFPGECQ YVLVQDYCGS<br>901 NPGTFRILVG NKGCSHPSVK CKKRVTILVE GGEIELFDGE VNVKRPMDKE<br>951 THFEVVESGR YIILLLGKAL SVVWDRHLSI SVVLKQTYQE KVCGLCGNFD<br>1001 GIQNNDLTSS NLQVEEDPVD FGNSWKVSSQ CADTRKVPLD SSPATCHNNI<br>1051 MKQTMVDSSC RILTSDVFQD CNKLVDPEPY LDVCIYDTCS CESIGDCACF<br>1101 CDTIAAYAHV CAQHGKVVTW RTATLCPQSC EERNLRENGY ECEWRYNSCA<br>1151 PACQVTCQHP EPLACPVQCV EGCHAHCPPG KILDELLQTC VDPEDCPVCE<br>1201 VAGRRFASGK KVTLNPSDPE HCQICHCDVV NLTCEACQEP 1240 |
| VWF A1 Domain SEQ ID NO: 212 (Amino acids 1241 to 1479 of SEQ ID NO: 21) | 1241 GGLVVPPTDA<br>1251 PVSPTTLYVE DISEPPLHDF YCSRLLDLVF LLDGSSRLSE AEFEVLKAFV<br>1301 VDMMERLRIS QKWVRVAVVE YHDGSHAYIG LKDRKRPSEL RRIASQVKYA<br>1351 GSQVASTSEV LKYTLFQIFS KIDRPEASRI ALLLMASQEP QRMSRNFVRY<br>1401 VQGLKKKKVI VIPVGIGPHA NLKQIRLIEK QAPENKAFVL SSVDELEQQR<br>1451 DEIVSYLCDL APEAPPPTLP PDMAQVTVG 1479 |
| VWF A2 Domain to C-terminus SEQ ID NO: 213 (Amino acids 1480 to 2813 of SEQ ID NO: 21) | 1480 PGLLGVSTLGP KRNSMVLDVA<br>1501 FVLEGSDKIG EADFNRSKEF MEEVIQRMDV GQDSIHVTVL QYSYMVTVEY<br>1551 PFSEAQSKGD ILQRVREIRY QGGNRTNTGL ALRYLSDHSF LVSQGDREQA<br>1601 PNLVYMVTGN PASDEIKRLP GDIQVVPIGV GPNANVQELE RIGWPNAPIL<br>1651 IQDFETLPRE APDLVLQRCC SGEGLQIPTL SPAPDCSQPL DVILLLDGSS<br>1701 SFPASYFDEM KSFAKAFISK ANIGPRLTQV SVLQYGSITT IDVPWNVVPE<br>1751 KAHLLSLVDV MQREGGPSQI GDALGFAVRY LTSEMHGARP GASKAVVILV<br>1801 TDVSVDSVDA AADAARSNRV TVFPIGIGDR YDAAQLRILA GPAGDSNVVK<br>1851 LQRIEDLPTM VTLGNSFLHK LCSGFVRICM DEDGNEKRPG DVWTLPDQCH<br>1901 TVTCQPDGQT LLKSHRVNCD RGLRPSCPNS QSPVKVEETC GCRWTCPCVC<br>1951 TGSSTRHIVT FDGQNFKLTG SCSYVLFQNK EQDLEVILHN GACSPGARQG<br>2001 CMKSIEVKHS ALSVEXHSDM EVTVNGRLVS VPYVGGNMEV NVYGAIMHEV<br>2051 RFNHLGHIFT FTPQNNEFQL QLSPKTFASK TYGLCGICDE NGANDFMLRD<br>2101 GTVTTDWKTL VQEWTVQRPG QTCQPILEEQ CLVPDSSHCQ VLLLPLFAEC<br>2151 HKVLAPATFY AICQQDSCHQ EQVCEVIASY AHLCRTNGVC VDWRTPDFCA<br>2201 MSCPPSLVYN HCEHGCPRHC DGNVSSCGDH PSEGCFCPPD KVMLEGSCVP<br>2251 EEACTQCIGE DGVQHQFLEA WVPDHQPCQI CTCLSGRKVN CTTQPCPTAK<br>2301 APTCGLCEVA RLRQNADQCC PEYECVCDPV SCDLPPVPHC ERGLQPTLTN<br>2351 PGECRPNFTC ACRKEECKRV SPPSCPPHRL PTLRKTQCCD EYECACNCVN<br>2401 STVSCPLGYL ASTATNDCGC TTTTCLPDKV CVHRSTIYPV GQFWEEGCDV<br>2451 CTCTDMEDAV MGLRVAQCSQ KPCEDSCRSG FTYVLHEGEC CGRCLPSACE<br>2501 VVTGSPRGDS QSSWKSVGSQ WASPENPCLI NECVRVKEEV FIQQRNVSCP<br>2551 QLEVPVCPSG FQLSCKTSAC CPSCRCERME ACMLNGTVIG PGKTVMIDVC<br>2601 TTCRCMVQVG VISGFKLECR KTTCNPCPLG YKEENNTGEC CGRCLPTACT<br>2651 IQLRGGQIMT LKRDETLQDG CDTHFCKVNE RGEYFWEKRV TGCPPFDEHK<br>2701 CLAEGGKIMK IPGTCCDTCE EPECNDITAR LQYVKVGSCK SEVEVDIHYC<br>2751 QGKCASKAMY SIDINDVQDQ CSCCSPTRTE PMQVALHCTN GSVVYHEVLN<br>2801 AMECKCSPRK CSK 2813 |

The VWF protein as used herein can be a VWF fragment comprising a D' domain and a D3 domain of VWF, wherein the VWF fragment binds to Factor VIII (FVIII) and inhibits binding of endogenous VWF (full-length VWF) to FVIII. The VWF fragment comprising the D' domain and the D3 domain can further comprise a VWF domain selected from the group consisting of an A1 domain, an A2 domain, an A3 domain, a D1 domain, a D2 domain, a D4 domain, a B1 domain, a B2 domain, a B3 domain, a C1 domain, a C2 domain, a CK domain, one or more fragments thereof, and any combinations thereof. In some embodiments, a VWF fragment comprises, consists essentially of, or consists of: (1) the D' and D3 domains of VWF or fragments thereof; (2) the D1, D', and D3 domains of VWF or fragments thereof; (3) the D2, D', and D3 domains of VWF or fragments thereof; (4) the D1, D2, D', and D3 domains of VWF or fragments thereof; or (5) the D1, D2, D', D3, and A1 domains of VWF or fragments thereof. The VWF fragment described herein does not contain a site binding to a VWF clearance receptor. In other embodiments, the VWF fragment described herein is not amino acids 764 to 1274 of SEQ ID NO: 21. The VWF fragment of the present disclosure can comprise any other sequences linked to or fused to the VWF fragment. For example, a VWF fragment described herein can further comprise a signal peptide.

In some embodiments, the VWF fragment comprising a D' domain and a D3 domain binds to or is associated with a FVIII protein. See, e.g., US 2015/0023959 A1, US 2015/0266943 A1, US 2016/0251408 A1, US 2017/0073393 A1, US 2018/185455 A1, US 2018/0051067 A1, US 2017/0152300 A1, U.S. Pat. No. 9,878,017 B2, U.S. Pat. No. 9,458,223 B2, U.S. Pat. No. 8,575,104 B2, WO 2017/117630 A1, US 2018/0161402 A1, WO 2017/117631 A1, WO 2018/087271 A1, U.S. Pat. No. 9,107,902 B2, WO 2017/222337 A1, WO 2015/185758 A1, each of which is incorporated by reference herein in its entirety. By binding to or associating with a FVIII protein, a VWF fragment of the disclosure protects FVIII from protease cleavage and FVIII activation, stabilizes the heavy chain and light chain of FVIII, and prevents clearance of FVIII by scavenger receptors. In other embodiments, the VWF fragment binds to or associates with a FVIII protein and blocks or prevents binding of the FVIII protein to phospholipid and activated Protein C. By preventing or inhibiting binding of the FVIII protein with endogenous, full-length VWF, the VWF fragment of the disclosure reduces the clearance of FVIII by VWF clearance receptors and thus extends half-life of the chimeric polypeptide. The half-life extension of a chimeric polypeptide is thus due to the binding of or associating with the VWF fragment lacking a VWF clearance receptor binding site to the FVIII protein and shielding or protecting of the FVIII protein by the VWF fragment from endogenous VWF which contains the VWF clearance receptor binding site. The FVIII protein bound to or protected by the VWF fragment can also allow recycling of a FVIII protein. By eliminating the VWF clearance pathway receptor binding sites contained in the full length VWF molecule, the FVIII/VWF heterodimers of the disclosure are shielded from the VWF clearance pathway, further extending FVIII half-life.

In some embodiments, a VWF protein useful for the present disclosure comprises a D' domain and a D3 domain of VWF, wherein the D' domain is at least 60%, 70%, 80%, 85%, 90%, 95%, 96%, 97%, 98%, 99%, or 100% identical to amino acids 764 to 866 of SEQ ID NO: 21, wherein the VWF protein prevents or inhibits binding of endogenous VWF to FVIII. In other embodiments, a VWF protein comprises the D' domain and the D3 domain of VWF, wherein the D3 domain is at least 60%, 70%, 80%, 85%, 90%, 95%, 96%, 97%, 98%, 99%, or 100% identical to amino acids 867 to 1240 of SEQ ID NO: 21, wherein the VWF protein prevents or inhibits binding of endogenous VWF to FVIII. In some embodiments, a VWF protein described herein comprises, consists essentially of, or consists of the D' domain and D3 domain of VWF, which are at least 60%, 70%, 80%, 85%, 90%, 95%, 96%, 97%, 98%, 99%, or 100% identical to amino acids 764 to 1240 of SEQ ID NO: 21, wherein the VWF protein prevents or inhibits binding of endogenous VWF to FVIII. In other embodiments, a VWF protein comprises, consists essentially of, or consists of the D1, D2, D', and D3 domains at least 60%, 70%, 80%, 85%, 90%, 95%, 96%, 97%, 98%, 99%, or 100% identical to amino acids 23 to 1240 of SEQ ID NO: 21, wherein the VWF protein prevents or inhibits binding of endogenous VWF to FVIII. In still other embodiments, the VWF protein further comprises a signal peptide operably linked thereto.

In some embodiments, a VWF protein useful for the disclosure consists essentially of or consists of (1) the D'D3 domain, the D1D'D3 domain, D2D'D3 domain, or D1D2D'D3 domain and (2) an additional VWF sequence up to about 10 amino acids (e.g., any sequences from amino acids 764 to 1240 of SEQ ID NO: 21 to amino acids 764 to 1250 of SEQ ID NO: 21), up to about 15 amino acids (e.g., any sequences from amino acids 764 to 1240 of SEQ ID NO: 21 to amino acids 764 to 1255 of SEQ ID NO: 21), up to about 20 amino acids (e.g., any sequences from amino acids 764 to 1240 of SEQ ID NO: 21 to amino acids 764 to 1260 of SEQ ID NO: 21), up to about 25 amino acids (e.g., any sequences from amino acids 764 to 1240 of SEQ ID NO: 21 to amino acids 764 to 1265 of SEQ ID NO: 21), or up to about 30 amino acids (e.g., any sequences from amino acids 764 to 1240 of SEQ ID NO: 21 to amino acids 764 to 1260 of SEQ ID NO: 21). In some embodiments, the VWF protein comprising or consisting essentially of the D' domain and the D3 domain is neither amino acids 764 to 1274 of SEQ ID NO: 21 nor the full-length mature VWF. In some embodiments, the D1D2 domain is expressed in trans with the D'D3 domain. In some embodiments, the D1D2 domain is expressed in cis with the D'D3 domain.

In other embodiments, the VWF protein comprising the D'D3 domains linked to the D1D2 domains further comprises an intracellular cleavage site, e.g., (a cleavage site by PACE (furin) or PC5), allowing cleavage of the D1D2 domains from the D'D3 domains upon expression. Non-limiting examples of the intracellular cleavage site are disclosed elsewhere herein.

In yet other embodiments, a VWF protein comprises a D' domain and a D3 domain, but does not comprise an amino acid sequence selected from the group consisting of (1) amino acids 1241 to 2813 corresponding to SEQ ID NO: 21, (2) amino acids 1270 to amino acids 2813 corresponding to SEQ ID NO: 21, (3) amino acids 1271 to amino acids 2813 corresponding to SEQ ID NO: 21, (4) amino acids 1272 to amino acids 2813 corresponding to SEQ ID NO: 21, (5) amino acids 1273 to amino acids 2813 corresponding to SEQ ID NO: 21, (6) amino acids 1274 to amino acids 2813 corresponding to SEQ ID NO: 21, and any combinations thereof.

In still other embodiments, a VWF protein of the present disclosure comprises, consists essentially of, or consists of an amino acid sequence corresponding to the D' domain, D3 domain, and A1 domain, wherein the amino acid sequence is at least 60%, 70%, 75%, 80%, 85%, 90%, 95%, 96%, 97%, 98%, 99%, or 100% identical to amino acid 764 to 1479 of SEQ ID NO: 21, wherein the VWF protein prevents binding of endogenous VWF to FVIII. In particular embodiments, the VWF protein is not amino acids 764 to 1274 of SEQ ID NO: 21.

In some embodiments, a VWF protein of the disclosure comprises a D' domain and a D3 domain, but does not comprise at least one VWF domain selected from the group consisting of (1) an A1 domain, (2) an A2 domain, (3) an A3 domain, (4) a D4 domain, (5) a B1 domain, (6) a B2 domain, (7) a B3 domain, (8) a C1 domain, (9) a C2 domain, (10) a CK domain, (11) a CK domain and C2 domain, (12) a CK domain, a C2 domain, and a C1 domain, (13) a CK domain, a C2 domain, a C1 domain, a B3 domain, (14) a CK domain, a C2 domain, a C1 domain, a B3 domain, a B2 domain, (15) a CK domain, a C2 domain, a C1 domain, a B3 domain, a B2 domain, and a B1 domain, (16) a CK domain, a C2 domain, a C1 domain, a B3 domain, a B2 domain, a B1 domain, and a D4 domain, (17) a CK domain, a C2 domain, a C1 domain, a B3 domain, a B2 domain, a B1 domain, a D4 domain, and an A3 domain, (18) a CK domain, a C2 domain, a C1 domain, a B3 domain, a B2 domain, a B1 domain, a D4 domain, an A3 domain, and an A2 domain, (19) a CK domain, a C2 domain, a C1 domain, a B3 domain, a B2 domain, a B1 domain, a D4 domain, an A3 domain, an A2 domain, and an A1 domain, and (20) any combinations thereof.

In yet other embodiments, the VWF protein comprises the D'D3 domains and one or more domains or modules. Examples of such domains or modules include, but are not limited to, the domains and modules disclosed in Zhour et al., Blood published online Apr. 6, 2012: DOI 10.1182/blood-2012-01-405134, which is incorporated herein by reference in its entirety. For example, the VWF protein can comprise the D'D3 domain and one or more domains or modules selected from the group consisting of A1 domain, A2 domain, A3 domain, D4N module, VWD4 module, C8-4 module, TIL-4 module, C1 module, C2 module, C3 module, C4 module, C5 module, C5 module, C6 module, and any combinations thereof.

In still other embodiments, the VWF protein is linked to a heterologous moiety, wherein the heterologous moiety is linked to the N-terminus or the C-terminus of the VWF protein or inserted immediately downstream of one or more amino acids (e.g., one or more XTEN insertion sites) in the VWF protein. For example, the insertion sites for the heterologous moiety in the VWF protein can be in the D' domain, the D3 domain, or both. The heterologous moiety can be a half-life extender.

In certain embodiments, a VWF protein useful for the disclosure forms a multimer, e.g., dimer, trimer, tetramer, pentamer, hexamer, heptamer, or the higher order multimers. In other embodiments, the VWF protein is a monomer having only one VWF protein. In some embodiments, the VWF protein of the present disclosure can have one or more amino acid substitutions, deletions, additions, or modifications. In some embodiments, the VWF protein can include amino acid substitutions, deletions, additions, or modifications such that the VWF protein is not capable of forming a disulfide bond or forming a dimer or a multimer. In other embodiments, the amino acid substitution is within the D' domain and the D3 domain. In a particular embodiment, a VWF protein useful for the disclosure contains at least one amino acid substitution at a residue corresponding to residue 1099, residue 1142, or both residues 1099 and 1142 corresponding to SEQ ID NO: 21. The at least one amino acid substitution can be any amino acids that are not occurring naturally in the wild type VWF. For example, the amino acid substitution can be any amino acids other than cysteine, e.g., Isoleucine, Alanine, Leucine, Asparagine, Lysine, Aspartic acid, Methionine, Phenylalanine, Glutamic acid, Threonine, Glutamine, Tryptophan, Glycine, Valine, Proline, Serine, Tyrosine, Arginine, or Histidine. In another example, the amino acid substitution has one or more amino acids that prevent or inhibit the VWF proteins from forming multimers.

In certain embodiments, the VWF protein useful herein can be further modified to improve its interaction with FVIII, e.g., to improve binding affinity to FVIII. As a non-limiting example, the VWF protein comprises a serine residue at the residue corresponding to amino acid 764 of SEQ ID NO: 21 and a lysine residue at the residue corresponding to amino acid 773 of SEQ ID NO: 21. Residues 764 and/or 773 can contribute to the binding affinity of the VWF proteins to FVIII. In other embodiments, The VWF proteins useful for the disclosure can have other modifications, e.g., the protein can be pegylated, glycosylated, hesylated, or polysialylated.

In certain embodiments, the chimeric polypeptide disclosed herein comprises a VWF protein comprising a VWF fragment, an XTEN sequence, an a2 linker of FVIII, and a Fc region. In some embodiments, the VWF protein comprises, as ordered from N-terminal to C-terminal, a VWF fragment, fused to an XTEN sequence, fused to an a2 linker, fused to a Fc region. In certain embodiments, the VWF protein comprises a D' domain of VWF comprising the amino acid sequence of SEQ ID NO: 210, a D3 domain of VWF comprising the amino acid sequence of SEQ ID NO: 214, an XTEN sequence comprising the amino acid sequence of SEQ ID NO: 58 (AE144_5A), an a2 linker comprising the amino acid sequence of SEQ ID NO: 88, and/or a Fc region comprising the amino acid sequence of SEQ ID NO: 217.

In one specific embodiment, the chimeric polypeptide is rFVIIIFc-VWF-XTEN and comprises a VWF protein comprising the amino acid sequence of SEQ ID NO: 202.

In some embodiments, the VWF protein comprises a VWF fragment comprising a D1, D2, D', and/or D3 domain of VWF. In one embodiment, the VWF fragment comprises a D1D2 domain of VWF comprising the amino acid sequence of SEQ ID NO: 209. In some embodiments, the VWF protein further comprises a VWF signal peptide sequence. In one embodiment, the VWF signal peptide comprises the amino acid sequence of SEQ ID NO: 208. In one specific embodiment, the VWF protein comprises a VWF signal peptide comprising the amino acid sequence of SEQ ID NO: 208, a D1D2 region of VWF comprising the amino acid sequence of SEQ ID NO: 209, a D' domain of VWF comprising the amino acid sequence of SEQ ID NO: 210, a D3 domain of VWF comprising the amino acid sequence of SEQ ID NO: 214, an XTEN sequence comprising the amino acid sequence of SEQ ID NO: 58 (AE144_5A), an a2 linker comprising the amino acid sequence of SEQ ID NO: 88, and/or a Fc region comprising the amino acid sequence of SEQ ID NO: 217.

In one specific embodiment, the chimeric polypeptide is rFVIIIFc-VWF-XTEN and comprises a VWF protein comprising the amino acid sequence of SEQ ID NO: 205. In another specific embodiment, rFVIIIFc-VWF-XTEN comprises a VWF protein encoded by the nucleic acid sequence of SEQ ID NO: 206 or a fragment thereof. Additional exemplary polypeptide sequences relating to the VWF proteins of the chimeric polypeptides disclosed herein are provided in Tables 18-19.

III.C. Half-Life Extending Moieties

In some embodiments, the chimeric polypeptide of the disclosure comprises one or more half-life extending moieties. In some embodiments, the FVIII polypeptide of the chimeric polypeptide is fused to or associated with one or more half-life extending moieties (i.e., FVIII protein). In other embodiments, the chimeric polypeptide comprises at least two half-life extending moieties, a first half-life extending moiety fused to a FVIII polypeptide and a second half-life extending moiety fused to D'D3 domains of VWF. In some embodiments, the first half-life extending moiety is fused to the C-terminus or the N-terminus of the FVIII polypeptide. In some embodiments, the first half-life extending moiety is inserted within the FVIII polypeptide. In some embodiments, the first half-life extending moiety is inserted within the B domain of the FVIII polypeptide. In some embodiments, the first half-life extending moiety is inserted within the FVIII polypeptide immediately downstream of an amino acid corresponding to amino acid residue 745 of SEQ ID NO: 65. In some embodiments, the first heterologous moiety is fused to the FVIII polypeptide by a linker.

In certain embodiments, the D'D3 domains of VWF in the VWF fragment can be fused to or associated with a second half-life extending moiety. In some embodiments, the second half-life extending moiety is fused to the C-terminus or the N-terminus of the VWF fragment. In some embodiments, the second half-life extending moiety is inserted within the VWF fragment. In some embodiments, the second half-life extending moiety is fused to the C-terminus of the VWF fragment. In certain embodiments, wherein the second half-life extending moiety is fused to the VWF fragment by a linker.

In other embodiments, the chimeric polypeptide comprises a FVIII polypeptide and a VWF fragment comprising a D' domain and a D3 domain of VWF, wherein the D'D3 domain of VWF is fused to one or more half-life extending moieties and wherein the D'D3 domain of VWF and the FVIII polypeptide are associated with a bond stronger than naturally occurring bond between FVIII and VWF.

In some embodiments, the chimeric polypeptide comprises a FVIII polypeptide and a VWF fragment comprising a D' domain and a D3 domain of VWF, wherein the D'D3 domain of VWF is fused to the FVIII polypeptide by a linker. In some embodiments, the linker is a cleavable linker. In some embodiments, the D' domain and D3 domain of VWF are further associated with the FVIII polypeptide by at least one non-covalent bond. In certain embodiments, the D' domain and the D3 domain of VWF are further fused to an Fc. In some embodiments, the D' domain and D3 domain of VWF are fused to an Fc by a clinker. In some embodiments, the Fc is fused to a second Fc by an additional linker. In certain embodiments, the Fc and the second Fc are associated with each other by a covalent bond, e.g., a disulphide bond. In particular embodiments, the chimeric polypeptide comprises a FVIII polypeptide and a VWF fragment comprising a D' domain and a D3 domain of VWF as disclosed in International Publication No. WO 2017/222337 A1, which is incorporated by reference herein in its entirety.

The first half-life extending moiety, the second half-life extending moiety, or both can be selected from the group consisting of an FcRn binding partner, e.g., an albumin or an immunoglobulin Fc region, an XTEN sequence, the C-terminal peptide (CTP) of the β subunit of human chorionic gonadotropin, a PAS sequence, a HAP sequence, a transferrin, albumin-binding moieties, or any fragments, derivatives, variants, and any combination thereof.

III.C.1. Ig Constant Region or a Portion Thereof

In some embodiments, the chimeric polypeptide of the disclosure also includes a first Ig constant region or a portion thereof fused to a FVIII polypeptide by an optional linker. The first Ig constant region or the portion thereof can be inserted within the FVIII polypeptide or fused to the C-terminus or the N-terminus of the FVIII polypeptide. In some embodiments, the chimeric polypeptide further includes a second Ig constant region or a portion thereof fused to a VWF protein. The first Ig constant region or the portion thereof can be inserted within the VWF fragment or fused to the C-terminus or the N-terminus of the VWF fragment. In particular embodiments, the first Ig constant region is linked to or associated with the second Ig constant region by a covalent bond, e.g., a disulfide bond.

The Ig constant region or a portion thereof can improve pharmacokinetic or pharmacodynamic properties of the chimeric polypeptide in combination with an additional heterologous moiety, e.g., an XTEN sequence, and the VWF protein. In certain embodiments, the Ig constant region or a portion thereof extends a half-life of a molecule fused to the Ig constant region or a portion thereof.

An Ig constant region is comprised of domains denoted CH (constant heavy) domains (CH1, CH2, etc.). Depending on the isotype, (i.e. IgG, IgM, IgA, IgD, or IgE), the constant region can be comprised of three or four CH domains. Some isotypes (e.g. IgG) constant regions also contain a hinge region. See Janeway et al. 2001, Immunobiology, Garland Publishing, N.Y., N.Y.

An Ig constant region or a portion thereof for producing the chimeric polypeptide of the present disclosure can be obtained from a number of different sources. In some embodiments, an Ig constant region or a portion thereof is derived from a human Ig. It is understood, however, that the Ig constant region or a portion thereof can be derived from an Ig of another mammalian species, including for example, a rodent (e.g. a mouse, rat, rabbit, guinea pig) or non-human primate (e.g. chimpanzee, macaque) species. Moreover, the Ig constant region or a portion thereof can be derived from any Ig class, including IgM, IgG, IgD, IgA, and IgE, and any Ig isotype, including IgGl, IgG2, IgG3, and IgG4. In some embodiments, the human isotype IgG1 is used.

A variety of the Ig constant region gene sequences (e.g., human constant region gene sequences) are available in the form of publicly accessible deposits. Constant region domains sequence can be selected having a particular effector function (or lacking a particular effector function) or with a particular modification to reduce immunogenicity. Many sequences of antibodies and antibody-encoding genes have been published and suitable Ig constant region sequences (e.g., hinge, CH2, and/or CH3 sequences, or portions thereof) can be derived from these sequences using art recognized techniques. The genetic material obtained using any of the foregoing methods can then be altered or synthesized to obtain polypeptides of the present disclosure. It will further be appreciated that the scope of this disclosure encompasses alleles, variants and mutations of constant region DNA sequences.

The sequences of the Ig constant region or a portion thereof can be cloned, e.g., using the polymerase chain reaction and primers which are selected to amplify the domain of interest. To clone a sequence of the Ig constant region or a portion thereof from an antibody, mRNA can be isolated from hybridoma, spleen, or lymph cells, reverse transcribed into DNA, and antibody genes amplified by PCR. PCR amplification methods are described in detail in U.S. Pat. Nos. 4,683,195; 4,683,202; 4,800,159; 4,965,188;

and in, e.g., "PCR Protocols: A Guide to Methods and Applications" Innis et al. eds., Academic Press, San Diego, CA (1990); Ho et al. 1989. Gene 77:51; Horton et al. 1993. Methods Enzymol. 217:270). PCR can be initiated by consensus constant region primers or by more specific primers based on the published heavy and light chain DNA and amino acid sequences. As discussed above, PCR also can be used to isolate DNA clones encoding the antibody light and heavy chains. In this case the libraries can be screened by consensus primers or larger homologous probes, such as mouse constant region probes. Numerous primer sets suitable for amplification of antibody genes are known in the art (e.g., 5' primers based on the N-terminal sequence of purified antibodies (Benhar and Pastan. 1994. Protein Engineering 7:1509); rapid amplification of cDNA ends (Ruberti, F. et al. 1994. J. Immunol. Methods 173:33); antibody leader sequences (Larrick et al. 1989 Biochem. Biophys. Res. Commun. 160:1250)). The cloning of antibody sequences is further described in Newman et al., U.S. Pat. No. 5,658,570, filed Jan. 25, 1995, which is incorporated by reference herein.

An Ig constant region used herein can include all domains and the hinge region or portions thereof. In some embodiments, the Ig constant region or a portion thereof comprises CH2 domain, CH3 domain, and a hinge region, i.e., an Fc region or an FcRn binding partner.

As used herein, the term "Fc region" is defined as the portion of a polypeptide which corresponds to the Fc region of native Ig, i.e., as formed by the dimeric association of the respective Fc domains of its two heavy chains. A native Fc region forms a homodimer with another Fc region. In contrast, the term "genetically-fused Fc region" or "single-chain Fc region" (scFc region), as used herein, refers to a synthetic dimeric Fc region comprised of Fc domains genetically linked within a single polypeptide chain (i.e., encoded in a single contiguous genetic sequence).

In some embodiments, the "Fc region" refers to the portion of a single Ig heavy chain beginning in the hinge region just upstream of the papain cleavage site (i.e. residue 216 in IgG, taking the first residue of heavy chain constant region to be 114) and ending at the C-terminus of the antibody. Accordingly, a complete Fc domain comprises at least a hinge domain, a CH2 domain, and a CH3 domain.

The Fc region of an Ig constant region, depending on the Ig isotype can include the CH2, CH3, and CH4 domains, as well as the hinge region. Chimeric polypeptides comprising an Fc region of an Ig bestow several desirable properties on a chimeric polypeptide including increased stability, increased serum half-life (see Capon et al., 1989, Nature 337:525) as well as binding to Fc receptors such as the neonatal Fc receptor (FcRn) (U.S. Pat. Nos. 6,086,875, 6,485,726, 6,030,613; WO 03/077834; US2003-0235536A1), which are incorporated herein by reference in their entireties.

An Ig constant region or a portion thereof can be an FcRn binding partner. FcRn is active in adult epithelial tissues and expressed in the lumen of the intestines, pulmonary airways, nasal surfaces, vaginal surfaces, colon and rectal surfaces (U.S. Pat. No. 6,485,726). An FcRn binding partner is a portion of an Ig that binds to FcRn. Another example of an FcRn binding partner is albumin, further described below.

The FcRn receptor has been isolated from several mammalian species including humans. The sequences of the human FcRn, monkey FcRn, rat FcRn, and mouse FcRn are known (Story et al. 1994, J. Exp. Med. 180:2377). The FcRn receptor binds IgG (but not other Ig classes such as IgA, IgM, IgD, and IgE) at relatively low pH, actively transports the IgG transcellularly in a luminal to serosal direction, and then releases the IgG at relatively higher pH found in the interstitial fluids. It is expressed in adult epithelial tissue (U.S. Pat. Nos. 6,485,726, 6,030,613, 6,086,875; WO 03/077834; US2003-0235536A1) including lung and intestinal epithelium (Israel et al. 1997, Immunology 92:69) renal proximal tubular epithelium (Kobayashi et al. 2002, Am. J. Physiol. Renal Physiol. 282:F358) as well as nasal epithelium, vaginal surfaces, and biliary tree surfaces.

FcRn binding partners useful in the present disclosure encompass molecules that can be specifically bound by the FcRn receptor including whole IgG, the Fc fragment of IgG, and other fragments that include the complete binding region of the FcRn receptor. The region of the Fc portion of IgG that binds to the FcRn receptor has been described based on X-ray crystallography (Burmeister et al. 1994, Nature 372:379). The major contact area of the Fc with the FcRn is near the junction of the CH2 and CH3 domains. Fc-FcRn contacts are all within a single Ig heavy chain. The FcRn binding partners include whole IgG, the Fc fragment of IgG, and other fragments of IgG that include the complete binding region of FcRn. The major contact sites include amino acid residues 248, 250-257, 272, 285, 288, 290-291, 308-311, and 314 of the CH2 domain and amino acid residues 385-387, 428, and 433-436 of the CH3 domain. References made to amino acid numbering of Igs or Ig fragments, or regions, are all based on Kabat et al. 1991, Sequences of Proteins of Immunological Interest, U.S. Department of Public Health, Bethesda, Md.

Fc regions or FcRn binding partners bound to FcRn can be effectively shuttled across epithelial barriers by FcRn, thus providing a non-invasive means to systemically administer a desired therapeutic molecule. Additionally, fusion proteins comprising an Fc region or an FcRn binding partner are endocytosed by cells expressing the FcRn. But instead of being marked for degradation, these fusion proteins are recycled out into circulation again, thus increasing the in vivo half-life of these proteins. In certain embodiments, the portions of Ig constant regions are an Fc region or an FcRn binding partner that typically associates, via disulfide bonds and other non-specific interactions, with another Fc region or another FcRn binding partner to form dimers and higher order multimers.

Two FcRn receptors can bind a single Fc molecule. Crystallographic data suggest that each FcRn molecule binds a single polypeptide of the Fc homodimer. In some embodiments, linking the FcRn binding partner, e.g., an Fc fragment of an IgG, to a biologically active molecule provides a means of delivering the biologically active molecule orally, buccally, sublingually, rectally, vaginally, as an aerosol administered nasally or via a pulmonary route, or via an ocular route. In other embodiments, the chimeric polypeptide can be administered invasively, e.g., subcutaneously, intravenously.

An FcRn binding partner region is a molecule or a portion thereof that can be specifically bound by the FcRn receptor with consequent active transport by the FcRn receptor of the Fc region. Specifically bound refers to two molecules forming a complex that is relatively stable under physiologic conditions. Specific binding is characterized by a high affinity and a low to moderate capacity as distinguished from nonspecific binding which usually has a low affinity with a moderate to high capacity. Typically, binding is considered specific when the affinity constant KA is higher than $10^6$ $M^{-1}$, or higher than $10^8$ $M^{-1}$. If necessary, non-specific binding can be reduced without substantially affecting specific binding by varying the binding conditions. The appropriate binding conditions such as concentration of the molecules, ionic strength of the solution, temperature, time allowed for binding, concentration of a blocking agent (e.g. serum albumin, milk casein), etc., can be optimized by a skilled artisan using routine techniques.

In certain embodiments, a chimeric polypeptide of the disclosure comprises one or more truncated Fc regions that are nonetheless sufficient to confer Fc receptor (FcR) binding properties to the Fc region. For example, the portion of an Fc region that binds to FcRn (i.e., the FcRn binding portion) comprises from about amino acids 282-438 of IgG1, EU numbering (with the primary contact sites being amino acids 248, 250-257, 272, 285, 288, 290-291, 308-311, and 314 of the CH2 domain and amino acid residues 385-387, 428, and 433-436 of the CH3 domain. Thus, an Fc region of the disclosure can comprise or consist of an FcRn binding portion. FcRn binding portions can be derived from heavy chains of any isotype, including IgGI, IgG2, IgG3 and IgG4. In some embodiments, an FcRn binding portion from an antibody of the human isotype IgG1 is used. In other embodiments, an FcRn binding portion from an antibody of the human isotype IgG4 is used.

In other embodiments, the "Fc region" includes an amino acid sequence of an Fc domain or derived from an Fc domain. In certain embodiments, an Fc region comprises at least one of: a hinge (e.g., upper, middle, and/or lower hinge region) domain (about amino acids 216-230 of an antibody Fc region according to EU numbering), a CH2 domain (about amino acids 231-340 of an antibody Fc region according to EU numbering), a CH3 domain (about amino acids 341-438 of an antibody Fc region according to EU numbering), a CH4 domain, or a variant, portion, or fragment thereof. In other embodiments, an Fc region comprises a complete Fc domain (i.e., a hinge domain, a CH2 domain, and a CH3 domain). In some embodiments, an Fc region comprises, consists essentially of, or consists of a hinge domain (or a portion thereof) fused to a CH3 domain (or a portion thereof), a hinge domain (or a portion thereof) fused to a CH2 domain (or a portion thereof), a CH2 domain (or a portion thereof) fused to a CH3 domain (or a portion thereof), a CH2 domain (or a portion thereof) fused to both a hinge domain (or a portion thereof) and a CH3 domain (or a portion thereof). In still other embodiments, an Fc region lacks at least a portion of a CH2 domain (e.g., all or part of a CH2 domain). In a particular embodiment, an Fc region comprises or consists of amino acids corresponding to EU numbers 221 to 447.

The Fc regions denoted as F, F1, or F2 herein can be obtained from a number of different sources. In some embodiments, an Fc region of the polypeptide is derived from a human Ig. It is understood, however, that an Fc region can be derived from an Ig of another mammalian species, including for example, a rodent (e.g. a mouse, rat, rabbit, or guinea pig) or non-human primate (e.g. chimpanzee, macaque) species. Moreover, the polypeptide of the Fc domains or portions thereof can be derived from any Ig class, including IgM, IgG, IgD, IgA and IgE, and any Ig isotype, including IgGI, IgG2, IgG3 and IgG4. In other embodiments, the human isotype IgG1 is used.

In certain embodiments, the Fc variant confers a change in at least one effector function imparted by an Fc region comprising said wild-type Fc domain (e.g., an improvement or reduction in the ability of the Fc region to bind to Fc receptors (e.g. FcγRI, FcγRII, or FcγRIII) or complement proteins (e.g. C1q), or to trigger antibody-dependent cytotoxicity (ADCC), phagocytosis, or complement-dependent cytotoxicity (CDCC)). In other embodiments, the Fc variant provides an engineered cysteine residue.

The Fc regions of the disclosure can employ art-recognized Fc variants which are known to impart a change (e.g., an enhancement or reduction) in effector function and/or FcR or FcRn binding. Specifically, a binding molecule of the disclosure can include, for example, a change (e.g., a substitution) at one or more of the amino acid positions disclosed in International PCT Publications WO88/07089A1, WO96/14339A 1, WO98/05787A1, WO98/23289A 1, WO99/51642A1, WO99/58572A1, WO00/09560A2, WO00/32767A1, WO00/42072A2, WO02/44215A2, WO02/060919A2, WO03/074569A2, WO04/016750A2, WO04/029207A2, WO04/035752A2, WO04/063351A2, WO04/074455A2, WO04/099249A2, WO05/040217A2, WO04/044859, WO05/070963A1, WO05/077981A2, WO05/092925A2, WO05/123780A2, WO06/019447A1, WO06/047350A2, and WO06/085967A2; US Patent Publication Nos. US2007/0231329, US2007/0231329, US2007/0237765, US2007/0237766, US2007/0237767, US2007/0243188, US20070248603, US20070286859, US20080057056; or U.S. Pat. Nos. 5,648,260; 5,739,277; 5,834,250; 5,869,046; 6,096,871; 6,121,022; 6,194,551; 6,242,195; 6,277,375; 6,528,624; 6,538,124; 6,737,056; 6,821,505; 6,998,253; 7,083,784; 7,404,956, and 7,317,091, each of which is incorporated by reference herein. In some embodiments, the specific change (e.g., the specific substitution of one or more amino acids disclosed in the art) can be made at one or more of the disclosed amino acid positions. In other embodiments, a different change at one or more of the disclosed amino acid positions (e.g., the different substitution of one or more amino acid position disclosed in the art) can be made.

The Fc region or FcRn binding partner of IgG can be modified according to well recognized procedures such as site directed mutagenesis and the like to yield modified IgG or Fc fragments or portions thereof that will be bound by FcRn. Such modifications include modifications remote from the FcRn contact sites as well as modifications within the contact sites that preserve or even enhance binding to the FcRn. For example, the following single amino acid residues in human IgG1 Fc (Fc □1) can be substituted without significant loss of Fc binding affinity for FcRn: P238A, S239A, K246A, K248A, D249A, M252A, T256A, E258A, T260A, D265A, 5267A, H268A, E269A, D270A, E272A, L274A, N276A, Y278A, D280A, V282A, E283A, H285A, N286A, T289A, K290A, R292A, E293A, E294A, Q295A, Y296F, N297A, S298A, Y300F, R301A, V303A, V305A, T307A, L309A, Q311A, D312A, N315A, K317A, E318A, K320A, K322A, S324A, K326A, A327Q, P329A, A330Q, P331A, E333A, K334A, T335A, 5337A, K338A, K340A, Q342A, R344A, E345A, Q347A, R355A, E356A, M358A, T359A, K360A, N361A, Q362A, Y373A, S375A, D376A, A378Q, E380A, E382A, 5383A, N384A, Q386A, E388A, N389A, N390A, Y391F, K392A, L398A, S400A, D401A, D413A, K414A, R416A, Q418A, Q419A, N421A, V422A, S424A, E430A, N434A, T437A, Q438A, K439A, S440A, S444A, and K447A, where for example P238A represents wild type proline substituted by alanine at position number 238. As an example, some embodiments incorporate the N297A mutation, removing a highly conserved N-glycosylation site. In addition to alanine other amino acids can be substituted for the wild type amino acids at the positions specified above. Mutations can be introduced singly into Fc giving rise to more than one hundred Fc regions distinct from the native Fc. Additionally, combinations of two, three, or more of these individual mutations can be introduced together, giving rise to hundreds more Fc regions. Moreover, one of the Fc region of a construct of the disclosure can be mutated and the other Fc region of the construct not mutated at all, or they both can be mutated but with different mutations.

Certain of the above mutations can confer new functionality upon the Fc region or FcRn binding partner. For example, some embodiments incorporates N297A, removing a highly conserved N-glycosylation site. The effect of this mutation is to reduce immunogenicity, thereby enhancing circulating half-life of the Fc region, and to render the Fc region incapable of binding to FcgammaRI, FcgammaRIIA, FcgammaRIIB, and FcgammaRIIIA, without compromising affinity for FcRn (Routledge et al. 1995, Transplantation 60:847; Friend et al. 1999, Transplantation 68:1632; Shields et al. 1995, J. Biol. Chem. 276:6591). As a further example of new functionality arising from mutations described above affinity for FcRn can be increased beyond that of wild type in some instances. This increased affinity can reflect an increased "on" rate, a decreased "off" rate or both an increased "on" rate and a decreased "off" rate. Examples of mutations believed to impart an increased affinity for FcRn include, but not limited to, T256A, T307A, E380A, and N434A (Shields et al. 2001, J. Biol. Chem. 276:6591).

Additionally, at least three human Fc gamma receptors appear to recognize a binding site on IgG within the lower hinge region, generally amino acids 234-237. Therefore, another example of new functionality and potential decreased immunogenicity can arise from mutations of this region, as for example by replacing amino acids 233-236 of human IgG1 "ELLG" to the corresponding sequence from IgG2 "PVA" (with one amino acid deletion). It has been shown that FcγRI, FcγRII, and FcRIII, which mediate various effector functions will not bind to IgG1 when such mutations have been introduced. Ward and Ghetie 1995, Therapeutic Immunology 2:77 and Armour et al. 1999, Eur. J. Immunol. 29:2613.

In some embodiments, the Ig constant region or a portion thereof, e.g., an Fc region, is a polypeptide including the sequence PKNSSMISNTP (SEQ ID NO: 89 or SEQ ID NO: 3 of U.S. Pat. No. 5,739,277) and optionally further including a sequence selected from HQSLGTQ (SEQ ID NO: 90), HQNLSDGK (SEQ ID NO: 91), HQNISDGK (SEQ ID NO: 92), or VISSHLGQ (SEQ ID NO: 93) (or SEQ ID NOs: 11, 1, 2, and 31, respectively of U.S. Pat. No. 5,739,277).

In other embodiments, the immunoglobulin constant region or a portion thereof comprises an amino acid sequence in the hinge region or a portion thereof that forms one or more disulfide bonds with another immunoglobulin constant region or a portion thereof. The disulfide bond by the immunoglobulin constant region or a portion thereof places the first polypeptide comprising a FVIII polypeptide and the second polypeptide comprising the VWF fragment together so that endogenous VWF does not replace the VWF fragment and does not bind to the FVIII polypeptide. Therefore, the disulfide bond between the first immunoglobulin constant region or a portion thereof and a second immunoglobulin constant region or a portion thereof prevents interaction between endogenous VWF and the FVIII polypeptide. This inhibition of interaction between the VWF and the FVIII polypeptide allows the half-life of the chimeric polypeptide to go beyond the two fold limit. The hinge region or a portion thereof can further be linked to one or more domains of CH1, CH2, CH3, a fragment thereof, and any combinations thereof. In a particular embodiment, the immunoglobulin constant region or a portion thereof is a hinge region and CH2.

In certain embodiments, the Ig constant region or a portion thereof is hemi-glycosylated. For example, the chimeric polypeptide comprising two Fc regions or FcRn binding partners can contain a first, glycosylated, Fc region (e.g., a glycosylated CH2 region) or FcRn binding partner and a second, aglycosylated, Fc region (e.g., an aglycosylated CH2 region) or FcRn binding partner. In some embodiments, a linker can be interposed between the glycosylated and aglycosylated Fc regions. In other embodiments, the Fc region or FcRn binding partner is fully glycosylated, i.e., all of the Fc regions are glycosylated. In other embodiments, the Fc region can be aglycosylated, i.e., none of the Fc moieties are glycosylated.

In certain embodiments, a chimeric polypeptide of the disclosure comprises an amino acid substitution to an Ig constant region or a portion thereof (e.g., Fc variants), which alters the antigen-independent effector functions of the Ig constant region, in particular the circulating half-life of the protein.

Such proteins exhibit either increased or decreased binding to FcRn when compared to proteins lacking these substitutions and, therefore, have an increased or decreased half-life in serum, respectively. Fc variants with improved affinity for FcRn are anticipated to have longer serum half-lives, and such molecules have useful applications in methods of treating mammals where long half-life of the administered polypeptide is desired, e.g., to treat a chronic disease or disorder (see, e.g., U.S. Pat. Nos. 7,348,004, 7,404,956, and 7,862,820). In contrast, Fc variants with decreased FcRn binding affinity are expected to have shorter half-lives, and such molecules are also useful, for example, for administration to a mammal where a shortened circulation time can be advantageous, e.g. for in vivo diagnostic imaging or in situations where the starting polypeptide has toxic side effects when present in the circulation for prolonged periods. Fc variants with decreased FcRn binding affinity are also less likely to cross the placenta and, thus, are also useful in the treatment of diseases or disorders in pregnant women. In addition, other applications in which reduced FcRn binding affinity can be desired include those applications in which localization the brain, kidney, and/or liver is desired. In one exemplary embodiment, the chimeric polypeptides of the disclosure exhibit reduced transport across the epithelium of kidney glomeruli from the vasculature. In other embodiments, the chimeric polypeptides of the disclosure exhibit reduced transport across the blood brain barrier (BBB) from the brain, into the vascular space. In some embodiments, a protein with altered FcRn binding comprises at least one Fc region or FcRn binding partner (e.g, one or two Fc regions or FcRn binding partners) having one or more amino acid substitutions within the "FcRn binding loop" of an Ig constant region. The FcRn binding loop is comprised of amino acid residues 280-299 (according to EU numbering) of a wild-type, full-length, Fc region. In other embodiments, an Ig constant region or a portion thereof in a chimeric polypeptide of the disclosure having altered FcRn binding affinity comprises at least one Fc region or FcRn binding partner having one or more amino acid substitutions within the 15 Å FcRn "contact zone." As used herein, the term 15 Å FcRn "contact zone" includes residues at the following positions of a wild-type, full-length Fc moiety: 243-261, 275-280, 282-293, 302-319, 336-348, 367, 369, 372-389, 391, 393, 408, 424, 425-440 (EU numbering). In other embodiments, a Ig constant region or a portion thereof of the disclosure having altered FcRn binding affinity comprises at least one Fc region or FcRn binding partner having one or more amino acid substitutions at an amino acid position corresponding to any one of the following EU positions: 256, 277-281, 283-288, 303-309, 313, 338, 342, 376, 381, 384, 385, 387, 434 (e.g., N434A or N434K), and 438. Exemplary amino acid substitutions which altered FcRn binding activity are disclosed in International PCT Publication No. WO05/047327 which is incorporated by reference herein.

An Fc region or FcRn binding partner used in the disclosure can also comprise an art recognized amino acid substitution which alters the glycosylation of the chimeric polypeptide. For example, the Fc region or FcRn binding partner of the chimeric polypeptide linked to the D'D3 domain of VWF or a FVIII polypeptide can comprise an Fc region having a mutation leading to reduced glycosylation (e.g., N- or O-linked glycosylation) or can comprise an altered glycoform of the wild-type Fc moiety (e.g., a low fucose or fucose-free glycan).

In some embodiments, an unprocessed chimeric polypeptide of the disclosure can comprise a genetically fused Fc region (i.e., scFc region) having two or more of its constituent Ig constant region or a portion thereof independently selected from the Ig constant region or a portion thereof described herein. In some embodiments, the Fc regions of a dimeric Fc region are the same. In other embodiments, at least two of the Fc regions are different. For example, the Fc regions or FcRn binding partners of the proteins of the disclosure comprise the same number of amino acid residues or they can differ in length by one or more amino acid residues (e.g., by about 5 amino acid residues (e.g., 1, 2, 3, 4, or 5 amino acid residues), about 10 residues, about 15 residues, about 20 residues, about 30 residues, about 40 residues, or about 50 residues). In yet other embodiments, the Fc regions or FcRn binding partners of the protein of the disclosure can differ in sequence at one or more amino acid positions. For example, at least two of the Fc regions or FcRn binding partners can differ at about 5 amino acid positions (e.g., 1, 2, 3, 4, or 5 amino acid positions), about 10 positions, about 15 positions, about 20 positions, about 30 positions, about 40 positions, or about 50 positions).

III.C.2. XTEN Sequences

As used herein "XTEN sequence" refers to extended length polypeptides with non-naturally occurring, substantially non-repetitive sequences that are composed mainly of small hydrophilic amino acids, with the sequence having a low degree or no secondary or tertiary structure under physiologic conditions. As a chimeric polypeptide partner, XTENs can serve as a carrier, conferring certain desirable pharmacokinetic, physicochemical and pharmaceutical properties when linked to a VWF protein or a FVIII sequence of the disclosure to create a chimeric polypeptide. Such desirable properties include but are not limited to enhanced pharmacokinetic parameters and solubility characteristics. As used herein, "XTEN" specifically excludes antibodies or antibody fragments such as single-chain antibodies or Fc fragments of a light chain or a heavy chain.

In some embodiments, a shorter XTEN sequence provides an improved half-life extending property compared to a longer XTEN sequence when the XTEN sequence is fused to a VWF protein and/or a second Ig constant region or a portion thereof. Therefore, in some embodiments, the XTEN sequence fused to a VWF protein and/or the second Ig constant region or a portion thereof contains less than 288 amino acids in length, i.e., is shorter than 288 amino acids. In some embodiments, the XTEN sequence fused to a VWF protein and/or the second Ig constant region or a portion thereof consists of an amino acid sequence having a length of between 12 amino acids and 287 amino acids. In other embodiments, the XTEN sequence fused to a VWF protein and/or the second Ig constant region or a portion thereof comprise at least about 36 amino acids, at least about 42 amino acids, at least about 72 amino acids, or at least about 144 amino acids, but less than 288 amino acids. In other embodiments, the XTEN sequence fused to a VWF protein and/or the second Ig constant region or a portion thereof is selected from AE36, AG36, AE42, AG42, AE72, AG72, AE144, or AG144. In some embodiments, the XTEN sequence fused to a VWF protein and/or the second Ig constant region or a portion thereof is an amino acid sequence at least 80%, 85%, 90%, 95%, 96%, 97%, 98%, 99%, or 100% identical to SEQ ID NO: 9, SEQ ID NO: 10, SEQ ID NO: 11, or SEQ ID NO: 14, wherein the chimeric polypeptide exhibits an improved half-life compared to a chimeric polypeptide without the XTEN sequence.

The chimeric polypeptide of the disclosure can further comprise an additional (second, third, or more) XTEN sequences. The additional XTEN sequence can further be fused to the FVIII polypeptide or the first Ig constant region or a portion thereof. The additional XTEN sequences can be any length. For example, the additional XTEN sequence fused to the FVIII polypeptide or the first Ig constant region or a portion thereof is a peptide or a polypeptide having greater than about 20, 30, 40, 50, 60, 70, 80, 90, 100, 150, 200, 250, 300, 350, 400, 450, 500, 550, 600, 650, 700, 750, 800, 850, 900, 950, 1000, 1200, 1400, 1600, 1800, or 2000 amino acid residues. In certain embodiments, the additional XTEN sequence is a peptide or a polypeptide having greater than about 20 to about 3000 amino acid residues, greater than about 30 to about 2500 residues, greater than about 40 to about 2000 residues, greater than about 50 to about 1500 residues, greater than about 60 to about 1000 residues, greater than about 70 to about 900 residues, greater than about 80 to about 800 residues, greater than about 90 to about 700 residues, greater than about 100 to about 600 residues, greater than about 110 to about 500 residues, or greater than about 120 to about 400 residues. In certain embodiments, the additional XTEN that is fused to the FVIII polypeptide comprises at least about 288 amino acids. In particular embodiments, the additional XTEN that is fused to the FVIII polypeptide comprises about 288 amino acids. In particular embodiments, the additional XTEN that is fused to the FVIII polypeptide comprises an amino acid sequence at least about 70%, at least about 75%, at least about 80%, at least about 85%, at least about 90%, at least about 95%, at least about 96%, at least about 97%, at least about 98%, at least about 99%, or about 100% identical to the amino acid sequence of AE288 (SEQ ID NO: 8).

The XTEN sequences (i.e., the XTEN sequence fused to the VWF protein and/or the second Ig constant region or a portion thereof or the XTEN sequence fused to the FVIII polypeptide and/or the first Ig constant region or a portion thereof or inserted at one or more insertion sites within the FVIII polypeptide) can comprise one or more sequence motif of 9 to 14 amino acid residues or an amino acid sequence at least 80%, 90%, 91%, 92%, 93%, 94%, 95%, 96%, 97%, 98%, or 99% identical to the sequence motif, wherein the motif comprises, consists essentially of, or consists of 4 to 6 types of amino acids selected from the group consisting of glycine (G), alanine (A), serine (S), threonine (T), glutamate (E) and proline (P). See US 2010-0239554 A1.

In some embodiments, the XTEN sequence comprises non-overlapping sequence motifs in which at least about 80%, or at least about 85%, or at least about 90%, or at least about 91%, or at least about 92%, or at least about 93%, or at least about 94%, or at least about 95%, or at least about 96%, or at least about 97%, or at least about 98%, or at least about 99% or about 100% of the sequence consists of multiple units of non-overlapping sequences selected from a single motif family selected from Table 7, resulting in a family sequence. As used herein, "family" means that the XTEN has motifs selected only from a single motif category from Table 7; i.e., AD, AE, AF, AG, AM, AQ, BC, or BD XTEN, and that any other amino acids in the XTEN not from a family motif are selected to achieve a needed property, such as to permit incorporation of a restriction site by the encoding nucleotides, incorporation of a cleavage sequence, or to achieve a better linkage to FVIII or VWF. In some embodiments of XTEN families, an XTEN sequence comprises multiple units of non-overlapping sequence motifs of the AD motif family, or of the AE motif family, or of the AF motif family, or of the AG motif family, or of the AM motif family, or of the AQ motif family, or of the BC family, or of the BD family, with the resulting XTEN exhibiting the range of homology described above. In other embodiments, the XTEN comprises multiple units of motif sequences from two or more of the motif families of Table 7. These sequences can be selected to achieve desired physical/chemical characteristics, including such properties as net charge, hydrophilicity, lack of secondary structure, or lack of repetitiveness that are conferred by the amino acid composition of the motifs, described more fully below. In the embodiments hereinabove described in this paragraph, the motifs incorporated into the XTEN can be selected and assembled using the methods described herein to achieve an XTEN of about 36 to about 3000 amino acid residues.

TABLE 7

XTEN Sequence Motifs of 12 Amino Acids and Motif Families

| Motif Family* | MOTIF SEQUENCE | |
|---|---|---|
| AD | GESPGGSSGSES | (SEQ ID NO: 24) |
| AD | GSEGSSGPGESS | (SEQ ID NO: 25) |
| AD | GSSESGSSEGGP | (SEQ ID NO: 26) |
| AD | GSGGEPSESGSS | (SEQ ID NO: 27) |
| AE, AM | GSPAGSPTSTEE | (SEQ ID NO: 28) |
| AE, AM, AQ | GSEPATSGSETP | (SEQ ID NO: 29) |
| AE, AM, AQ | GTSESATPESGP | (SEQ ID NO: 30) |
| AE, AM, AQ | GTSTEPSEGSAP | (SEQ ID NO: 31) |
| AF, AM | GSTSESPSGTAP | (SEQ ID NO: 32) |
| AF, AM | GTSTPESGSASP | (SEQ ID NO: 33) |
| AF, AM | GTSPSGESSTAP | (SEQ ID NO: 34) |
| AF, AM | GSTSSTAESPGP | (SEQ ID NO: 35) |
| AG, AM | GTPGSGTASSSP | (SEQ ID NO: 36) |
| AG, AM | GSSTPSGATGSP | (SEQ ID NO: 37) |
| AG, AM | GSSPSASTGTGP | (SEQ ID NO: 38) |
| AG, AM | GASPGTSSTGSP | (SEQ ID NO: 39) |
| AQ | GEPAGSPTSTSE | (SEQ ID NO: 40) |

TABLE 7-continued

XTEN Sequence Motifs of 12 Amino Acids and Motif Families

| Motif Family* | MOTIF SEQUENCE | |
|---|---|---|
| AQ | GTGEPSSTPASE | (SEQ ID NO: 41) |
| AQ | GSGPSTESAPTE | (SEQ ID NO: 42) |
| AQ | GSETPSGPSETA | (SEQ ID NO: 43) |
| AQ | GPSETSTSEPGA | (SEQ ID NO: 44) |
| AQ | GSPSEPTEGTSA | (SEQ ID NO: 45) |
| BC | GSGASEPTSTEP | (SEQ ID NO: 46) |
| BC | GSEPATSGTEPS | (SEQ ID NO: 47) |
| BC | GTSEPSTSEPGA | (SEQ ID NO: 48) |
| BC | GTSTEPSEPGSA | (SEQ ID NO: 49) |
| BD | GSTAGSETSTEA | (SEQ ID NO: 50) |
| BD | GSETATSGSETA | (SEQ ID NO: 51) |
| BD | GTSESATSESGA | (SEQ ID NO: 52) |
| BD | GTSTEASEGSAS | (SEQ ID NO: 53) |

*Denotes individual motif sequences that, when used together in various permutations, results in a "family sequence"

In some embodiments, the XTEN sequence used in the disclosure is at least 60%, 70%, 80%, 85%, 90%, 91%, 92%, 93%, 94%, 95%, 96%, 97%, 98%, 99%, or 100% identical to a sequence selected from the group consisting of AE42, AG42, AE48, AM48, AE72, AG72, AE108, AG108, AE144, AF144, AG144, AE180, AG180, AE216, AG216, AE252, AG252, AE288, AG288, AE324, AG324, AE360, AG360, AE396, AG396, AE432, AG432, AE468, AG468, AE504, AG504, AF504, AE540, AG540, AF540, AD576, AE576, AF576, AG576, AE612, AG612, AE624, AE648, AG648, AG684, AE720, AG720, AE756, AG756, AE792, AG792, AE828, AG828, AD836, AE864, AF864, AG864, AM875, AE912, AM923, AM1318, BC864, BD864, AE948, AE1044, AE1140, AE1236, AE1332, AE1428, AE1524, AE1620, AE1716, AE1812, AE1908, AE2004A, AG948, AG1044, AG1140, AG1236, AG1332, AG1428, AG1524, AG1620, AG1716, AG1812, AG1908, and AG2004. See US 2010-0239554 A1.

In some embodiments, the XTEN sequence is at least 60%, 70%, 80%, 90%, 95%, 96%, 97%, 98%, 99% or 100% identical to an amino acid sequence selected from the group consisting of AE42 (SEQ ID NO: 9), AE72 (SEQ ID NO: 10), AE144_2A (SEQ ID NO: 55), AE144_3 B (SEQ ID NO: 56), AE144_4A (SEQ ID NO: 57), AE144_5A (SEQ ID NO: 58), AE144_6 B (SEQ ID NO: 59), AG144_A (SEQ ID NO: 60), AG144_B (SEQ ID NO: 61), AG144_C (SEQ ID NO: 62), AG144_F (SEQ ID NO: 63), AE864 (SEQ ID NO: 15), AE576 (SEQ ID NO: 16), AE288 (SEQ ID NO: 8), AE288_2 (SEQ ID NO: 54), AE144 (SEQ ID NO: 11), AG864 (SEQ ID NO: 17), AG576 (SEQ ID NO: 18), AG288 (SEQ ID NO: 19), AG144 (SEQ ID NO: 14), and any combinations thereof. In other embodiments, the XTEN sequence is selected from the group consisting of AE42 (SEQ ID NO: 9), AE72 (SEQ ID NO: 10), AE144_2A (SEQ ID NO: 55), AE144_3 B (SEQ ID NO: 56), AE144_4A (SEQ ID NO: 57), AE144_5A (SEQ ID NO: 58), AE144_6

B (SEQ ID NO: 59), AG144_A (SEQ ID NO: 60), AG144_B (SEQ ID NO: 61), AG144_C (SEQ ID NO: 62), AG144_F (SEQ ID NO: 63), AE864 (SEQ ID NO: 15), AE576 (SEQ ID NO: 16), AE288 (SEQ ID NO: 8), AE288_2 (SEQ ID NO: 54), AE144 (SEQ ID NO: 11), AG864 (SEQ ID NO: 17), AG576 (SEQ ID NO: 18), AG288 (SEQ ID NO: 19), AG144 (SEQ ID NO: 14), and any combinations thereof. In some embodiments, the XTEN sequence is AE288. The amino acid sequences for certain XTEN sequences of the disclosure are shown in Table 8.

TABLE 8

XTEN Sequences

| XTEN | Amino Acid Sequence |
|---|---|
| AE42 SEQ ID NO: 9 | GAPGSPAGSPTSTEEGTSESATPESGPGSEPATSGSETPASS |
| AE72 (SEQ ID NO: 10) | GAP TSESATPESG PGSEPATSGS ETPGTSESAT PESGPGSEPA TSGSETPGTS ESATPESGPG TSTEPSEGSA PGASS |
| AE144 (SEQ ID NO: 11) | GSEPATSGSETPGTSESATPESGPGSEPATSGSETPGSPAGSPTSTEEGTSTEPSEG SAPGSEPATSGSETPGSEPATSGSETPGSEPATSGSETPGTSTEPSEGSAPGTSESA PESGPGSEPATSGSETPGTSTEPSEGSAP |
| AE144_2A (SEQ ID NO: 55) | TSTEPSEGSAPGSPAGSPTSTEEGTSTEPSEGSAPGTSTEPSEGSAPGTSESATPESGPGTSTEPS EGSAPGTSESATPESGPGSEPATSGSETPGTSTEPSEGSAPGTSTEPSEGSAPGTSESATPESGP GTSESATPESGPG |
| AE144_3B (SEQ ID NO: 56) | SPAGSPTSTEEGTSESATPESGPGSEPATSGSETPGTSESATPESGPGTSTEPSEGSAPGTSTEPS EGSAPGTSTEPSEGSAPGTSTEPSEGSAPGTSTEPSEGSAPGSPAGSPTSTEE GTSTEPSEGSAPG |
| AE144_4A (SEQ ID NO: 57) | TSESATPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATPESGP GTSTEPSEGSAPG |
| AE144_5A (SEQ ID NO: 58) | TSESATPESGPGSEPATSGSETPGTSESATPESGPGSEPATSGSETPGTSESATPESGPGTSTEPS EGSAPGSPAGSPTSTEEGTSESATPESGPGSEPATSGSETPGTSESATPESGPGSPAGSPTSTEE GSPAGSPTSTEEG |
| AE144_6B (SEQ ID NO: 59) | TSTEPSEGSAPGTSESATPESGPGTSESATPESGPGTSESATPESGPGSEPATSGSETPGSEPATS GSETPGSPAGSPTSTEEGTSTEPSEGSAPGTSTEPSEGSAPGSEPATSGSETPGTSESATPESGPG TSTEPSEGSAPG |
| AG144 SEQ ID NO: 14 | GTPGSGTASSSPGSSTPSGATGSPGSSPSASTGTGPGSSPSASTGTGPGASPGTSST GSPGASPGTSSTGSPGSSTPSGATGSPGSSPSASTGTGPGASPGTSSTGSPGSSPSA STGTGPGTPGSGTASSSPGSSTPSGATGSP |
| AG144_A (SEQ ID NO: 60) | GASPGTSSTGSPGSSPSASTGTGPGSSPSASTGTGPGTPGSGTASSSPGSSTPSGATGSPGSSPS ASTGTGPGASPGTSSTGSPGTPGSGTASSSPGSSTPSGATGSPGTPGSGTASSSPGASPGTSSTG SPGASPGTSSTGSP |
| AG144_B (SEQ ID NO: 61) | GTPGSGTASSSPGSSTPSGATGSPGASPGTSSTGSPGTPGSGTASSSPGSSTPSGATGSPGSSPS ASTGTGPGSSPSASTGTGPGSSTPSGATGSPGSSTPSGATGSPGASPGTSSTGSPGASPGTSSTG SPGASPGTSSTGSP |
| AG144_C (SEQ ID NO: 62) | GTPGSGTASSSPGASPGTSSTGSPGASPGTSSTGSPGASPGTSSTGSPGSSPSASTGTGPGTPGS GTASSSPGASPGTSSTGSPGASPGTSSTGSPGASPGTSSTGSPGSSTPSGATGSPGSSTPSGATG SPGASPGTSSTGSP |
| AG144_F (SEQ ID NO: 63) | GSSPSASTGTGPGSSPSASTGTGPGASPGTSSTGSPGASPGTSSTGSPGSSTPSGATGSPGSSPS ASTGTGPGASPGTSSTGSPGSSPSASTGTGPGTPGSGTASSSPGSSTPSGATGSPGSSTPSGATG SPGASPGTSSTGSP |
| AE288 SEQ ID NO: 8 | GTSESATPESGPGSEPATSGSETPGTSESATPESGPGSEPATSGSETPGTSESATPESG PGTSTEPSEGSAPGSPAGSPTSTEEGTSESATPESGPGSEPATSGSETPGTSESATPES GPGSPAGSPTSTEEGSPAGSPTSTEEGSPAGSPTSTEEGTSESATPESGPGTSESATPE SGPGTSESATPESGPGSEPATSGSETPGSEPATSGSETPGSPAGSPTSTEEGTSTEPSE GSAPGTSTEPSEGSAPGSEPATSGSETPGTSESATPESGPGTSTEPSEGSAP |
| AE288_2 (SEQ ID NO: 54) | GSPAGSPTSTEEGTSESATPESGPGSEPATSGSETPGTSESATPESGPGTSTEPSEGSAPGTSTEP SEGSAPGTSTEPSEGSAPGTSTEPSEGSAPGTSTEPSEGSAPGSPAGSPTSTEE GTSTEPSEGSAPGTSESATPESGPGSEPATSGSETPGTSESATPESGPGSEPATSGSETPGTSESA TPESGPGTSTEPSEGSAPGTSESATPESGPGSPAGSPTSTEEGSPAGSPTSTEEGSPAGSPTSTEE GTSESATPESGPGTSTEPSEGSAP |
| AG288 SEQ ID NO: 19 | PGASPGTSSTGSPGASPGTSSTGSPGTPGSGTASSSPGSSTPSGATGSPGTPGSGTASS SPGSSTPSGATGSPGTPGSGTASSSPGSSTPSGATGSPGSSTPSGATGSPGSSPSASTG TGPGSSPSASTGTGPGASPGTSSTGSPGTPGSGTASSSPGSSTPSGATGSPGSSPSAST GTGPGSSPSASTGTGPGASPGTSSTGSPGSSTPSGATGSPGSSPSASTGTGPGASPGTS STGSPGSSPSASTGTGPGTPGSGTASSSPGSSTPSGATGS |

TABLE 8-continued

XTEN Sequences

| XTEN | Amino Acid Sequence |
|---|---|
| AE576 SEQ ID NO: 16 | GSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTST EEGTSESATPESGPGTSTEPSEGSAPGTSTEPSEGSAPGSPAGSPTSTEEGTSTEPSEG SAPGTSTEPSEGSAPGTSESATPESGPGTSTEPSEGSAPGTSESATPESGPGSEPATSG SETPGTSTEPSEGSAPGTSTEPSEGSAPGTSESATPESGPGTSESATPESGPGSPAGSP TSTEEGTSESATPESGPGSEPATSGSETPGTSESATPESGPGTSTEPSEGSAPGTSTEP SEGSAPGTSTEPSEGSAPGTSTEPSEGSAPGTSTEPSEGSAPGTSTEPSEGSAPGSPAG SPTSTEEGTSTEPSEGSAPGTSESATPESGPGSEPATSGSETPGTSESATPESGPGSEP ATSGSETPGTSESATPESGPGTSTEPSEGSAPGTSESATPESGPGSPAGSPTSTEEGSP AGSPTSTEEGSPAGSPTSTEEGTSESATPESGPGTSTEPSEGSAP |
| AG576 SEQ ID NO: 18 | PGTPGSGTASSSPGSSTPSGATGSPGSSPSASTGTGPGSSPSASTGTGPGSSTPSGATG SPGSSTPSGATGSPGASPGTSSTGSPGASPGTSSTGSPGASPGTSSTGSPGTPGSGTAS SSPGASPGTSSTGSPGASPGTSSTGSPGASPGTSSTGSPGSSPSASTGTGPGTPGSGTA SSSPGASPGTSSTGSPGASPGTSSTGSPGASPGTSSTGSPGSSTPSGATGSPGSSTPSG ATGSPGASPGTSSTGSPGTPGSGTASSSPGSSTPSGATGSPGSSTPSGATGSPGSSTPS GATGSPGSSPSASTGTGPGASPGTSSTGSPGASPGTSSTGSPGTPGSGTASSSPGASPG TSSTGSPGASPGTSSTGSPGASPGTSSTGSPGASPGTSSTGSPGTPGSGTASSSPGSST PSGATGSPGTPGSGTASSSPGSSTPSGATGSPGTPGSGTASSSPGSSTPSGATGSPGSS TPSGATGSPGSSPSASTGTGPGSSPSASTGTGPGASPGTSSTGSPGTPGSGTASSSPGS STPSGATGSPGSSPSASTGTGPGSSPSASTGTGPGASPGTSSTGS |
| AE864 SEQ ID NO: 15 | GSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTST EEGTSESATPESGPGTSTEPSEGSAPGTSTEPSEGSAPGSPAGSPTSTEEGTSTEPSEG SAPGTSTEPSEGSAPGTSESATPESGPGTSTEPSEGSAPGTSESATPESGPGSEPATSG SETPGTSTEPSEGSAPGTSTEPSEGSAPGTSESATPESGPGTSESATPESGPGSPAGSP TSTEEGTSESATPESGPGSEPATSGSETPGTSESATPESGPGTSTEPSEGSAPGTSTEP SEGSAPGTSTEPSEGSAPGTSTEPSEGSAPGTSTEPSEGSAPGTSTEPSEGSAPGSPAG SPTSTEEGTSTEPSEGSAPGTSESATPESGPGSEPATSGSETPGTSESATPESGPGSEP ATSGSETPGTSESATPESGPGTSTEPSEGSAPGTSESATPESGPGSPAGSPTSTEEGSP AGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPG SPAGSPTSTEEGTSESATPESGPGSEPATSGSETPGTSESATPESGPGSPAGSPTSTEE GSPAGSPTSTEEGTSTEPSEGSAPGTSESATPESGPGTSESATPESGPGTSESATPESG PGSEPATSGSETPGSEPATSGSETPGSPAGSPTSTEEGTSTEPSEGSAPGTSTEPSEGS APGSEPATSGSETPGTSESATPESGPGTSTEPSEGSAP |
| AG864 SEQ ID NO: 17 | GASPGTSSTGSPGSSPSASTGTGPGSSPSASTGTGPGTPGSGTASSSPGSSTPSGATGS PGSSPSASTGTGPGASPGTSSTGSPGTPGSGTASSSPGSSTPSGATGSPGTPGSGTASS SPGASPGTSSTGSPGASPGTSSTGSPGTPGSGTASSSPGSSTPSGATGSPGASPGTSST GSPGTPGSGTASSSPGSSTPSGATGSPGSSPSASTGTGPGSSPSASTGTGPGSSTPSGA TGSPGSSTPSGATGSPGASPGTSSTGSPGASPGTSSTGSPGASPGTSSTGSPGTPGSGT ASSSPGASPGTSSTGSPGASPGTSSTGSPGASPGTSSTGSPGSSPSASTGTGPGTPGSG TASSSPGASPGTSSTGSPGASPGTSSTGSPGASPGTSSTGSPGSSTPSGATGSPGSSTP SGATGSPGASPGTSSTGSPGTPGSGTASSSPGSSTPSGATGSPGSSTPSGATGSPGSST PSGATGSPGSSPSASTGTGPGASPGTSSTGSPGASPGTSSTGSPGTPGSGTASSSPGAS PGTSSTGSPGASPGTSSTGSPGASPGTSSTGSPGASPGTSSTGSPGTPGSGTASSSPGS STPSGATGSPGTPGSGTASSSPGSSTPSGATGSPGTPGSGTASSSPGSSTPSGATGSPG SSTPSGATGSPGSSPSASTGTGPGSSPSASTGTGPGASPGTSSTGSPGTPGSGTASSSP GSSTPSGATGSPGSSPSASTGTGPGSSPSASTGTGPGASPGTSSTGSPGASPGTSSTGS PGSSTPSGATGSPGSSPSASTGTGPGASPGTSSTGSPGSSPSASTGTGPGTPGSGTASS SPGSSTPSGATGSPGSSTPSGATGSPGASPGTSSTGSP |

In those embodiments wherein the XTEN component(s) have less than 100% of its amino acids consisting of 4, 5, or 6 types of amino acid selected from glycine (G), alanine (A), serine (S), threonine (T), glutamate (E) and proline (P), or less than 100% of the sequence consisting of the sequence motifs from Table 7 or the XTEN sequences of Table 8, the other amino acid residues of the XTEN are selected from any of the other 14 natural L-amino acids, but are preferentially selected from hydrophilic amino acids such that the XTEN sequence contains at least about 90%, 91%, 92%, 93%, 94%, 95%, 96%, 97%, 98%, or at least about 99% hydrophilic amino acids. The XTEN amino acids that are not glycine (G), alanine (A), serine (S), threonine (T), glutamate (E) and proline (P) are either interspersed throughout the XTEN sequence, are located within or between the sequence motifs, or are concentrated in one or more short stretches of the XTEN sequence, e.g., to create a linker between the XTEN and the FVIII or VWF components. In such cases where the XTEN component comprises amino acids other than glycine (G), alanine (A), serine (S), threonine (T), glutamate (E) and proline (P), it is preferred that less than about 2% or less than about 1% of the amino acids be hydrophobic residues such that the resulting sequences generally lack secondary structure, e.g., not having more than 2% alpha helices or 2% beta-sheets, as determined by the methods disclosed herein. Hydrophobic residues that are less favored in construction of XTEN include tryptophan, phenylalanine, tyrosine, leucine, isoleucine, valine, and methionine. Additionally, one can design the XTEN sequences to contain less than 5% or less than 4% or less than 3% or less than 2% or less than 1% or none of the following amino acids: cysteine (to avoid disulfide formation and oxidation), methionine (to avoid oxidation), asparagine and glutamine (to avoid desamidation). Thus, in some embodiments, the XTEN component comprising other amino acids in addition to glycine (G), alanine (A), serine (S), threonine (T), glutamate (E) and proline (P) have a sequence with less than 5% of the residues contributing to alpha-helices and beta-sheets as measured by the Chou-Fasman algorithm and have at least 90%, or at least about 95% or more random coil formation as measured by the GOR algorithm.

In further embodiments, the XTEN sequence used in the disclosure affects the physical or chemical property, e.g., pharmacokinetics, of the chimeric polypeptide of the present disclosure. The XTEN sequence used in the present disclosure can exhibit one or more of the following advantageous properties: conformational flexibility, enhanced aqueous solubility, high degree of protease resistance, low immunogenicity, low binding to mammalian receptors, or increased hydrodynamic (or Stokes) radii. In some embodiments, the XTEN sequence linked to a FVIII protein in this disclosure increases pharmacokinetic properties such as longer terminal half-life or increased area under the curve (AUC), so that the chimeric polypeptide described herein stays in vivo for an increased period of time compared to wild type FVIII. In further embodiments, the XTEN sequence used in this disclosure increases pharmacokinetic properties such as longer terminal half-life or increased area under the curve (AUC), so that FVIII protein stays in vivo for an increased period of time compared to wild type FVIII.

A variety of methods and assays can be employed to determine the physical/chemical properties of proteins comprising the XTEN sequence. Such methods include, but are not limited to analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Amau et al., Prot Expr and Purif 48, 1-13 (2006).

Additional examples of XTEN sequences that can be used according to the present disclosure and are disclosed in US Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, WO 2011028344 A2, or WO 20130122617 A1.

III.C.2. Albumins

An albumin or a portion thereof can be an FcRn binding partner. In certain aspects, a chimeric polypeptide used in the methods of the present disclosure comprises at least one albumin polypeptide or fragment, variant, or derivative thereof. Human serum albumin (HSA, or HA), a protein of 609 amino acids in its full-length form, is responsible for a significant proportion of the osmotic pressure of serum and also functions as a carrier of endogenous and exogenous ligands. The term "albumin" as used herein includes full-length albumin or a functional fragment, variant, derivative, or analog thereof. Examples of albumin or the fragments or variants thereof are disclosed in US Pat. Publ. Nos. 2008/0194481A1, 2008/0004206 A1, 2008/0161243 A1, 2008/0261877 A1, or 2008/0153751 A1 or PCT Appl. Publ. Nos. 2008/033413 A2, 2009/058322 A1, or 2007/021494 A2, which are incorporated herein by reference in their entireties.

The albumin-binding polypeptides (ABPs) can compromise, without limitation, bacterial albumin-binding domains, albumin-binding peptides, or albumin-binding antibody fragments that can bind to albumin. Domain 3 from streptococcal protein G, as disclosed by Kraulis et al., FEBS Lett. 378:190-194 (1996) and Linhult et al., Protein Sci. 11:206-213 (2002) is an example of a bacterial albumin-binding domain. Examples of albumin-binding peptides are disclosed in Dennis et al., J. Biol. Chem. 2002, 277: 35035-35043 (2002). Examples of albumin-binding antibody fragments are disclosed in Muller and Kontermann, Curr. Opin. Mol. Ther. 9:319-326 (2007); Roovers et al., Cancer Immunol. Immunother. 56:303-317 (2007), and Holt et al., Prot. Eng. Design Sci., 21:283-288 (2008), which are incorporated herein by reference in their entireties.

In certain aspects, a chimeric polypeptide used in the methods of the present disclosure comprises at least one attachment site for a non-polypeptide small molecule, variant, or derivative that can bind to albumin thereof. For example, the chimeric polypeptide can include one or more organic albumin-binding moieties. An example of such albumin-binding moieties is 2-(3-maleimidopropanamido)-6-(4-(4-iodophenyl)butanamido)hexanoate ("Albu" tag) as disclosed by Trussel et al., Bioconjugate Chem. 20:2286-2292 (2009).

In certain embodiments, the a VWF fragment described herein is fused to an albumin. In some embodiments, the VWF fragment-albumin constructs form homodimers. In some embodiments, the D'D3 domain of VWF that is fused to the albumin associates with a FVIII polypeptide. In certain embodiments, the D'D3 domain of VWF fused to the albumin associated with the FVIII polypeptide by an interaction stronger than the natural non-covalent interactions between wild-type FVIII and VWF. In particular embodiments, the D'D3 domain of VWF and/or the FVIII polypeptide comprises one or more mutation that increases the affinity between the D'D3 domain of VWF and the FVIII polypeptide. In certain embodiments, the D'D3 domain of VWF and/or the FVIII polypeptide comprises one or more mutation that allows for a disulfide bond to form between the D'D3 domain of VWF and/or the FVIII polypeptide.

III.C.3. CTP

In certain aspects, a chimeric polypeptide used in the methods of the present disclosure comprises at least one C-terminal peptide (CTP) of the β subunit of human chorionic gonadotropin or fragment, variant, or derivative thereof. CTP peptides are known to increase the half-life of that protein. See, e.g., U.S. Pat. No. 5,712,122, incorporated by reference herein in its entirety. Non-limiting exemplary CTP peptides are disclosed in U.S. Patent Application Publication No. US 2009/0087411 A1, incorporated by reference.

III.C.4. PAS

In certain aspects, a chimeric polypeptide used in the methods of the present disclosure comprises at least one PAS peptide or fragment, variant, or derivative thereof. A PAS peptide or PAS sequence, as used herein, means an amino acid sequence comprising mainly alanine and serine residues or comprising mainly alanine, serine, and proline residues, the amino acid sequence forming random coil conformation under physiological conditions. Accordingly, the PAS sequence is a building block, an amino acid polymer, or a sequence cassette comprising, consisting essentially of, or consisting of alanine, serine, and proline which can be used as a part of the heterologous moiety in the chimeric polypeptide. An amino acid polymer also can form random coil conformation when residues other than alanine, serine, and proline are added as a minor constituent in the PAS sequence. By "minor constituent" is meant that that amino acids other than alanine, serine, and proline can be added in the PAS sequence to a certain degree, e.g., up to about 12%, i.e., about 12 of 100 amino acids of the PAS sequence, up to about 10%, up to about 9%, up to about 8%, about 6%, about 5%, about 4%, about 3%, i.e. about 2%, or about 1%, of the amino acids. The amino acids different from alanine, serine and proline cab be selected from the group consisting of Arg, Asn, Asp, Cys, Gln, Glu, Gly, His, Ile, Leu, Lys, Met, Phe, Thr, Trp, Tyr, and Val. Under physiological conditions, a PAS peptide forms a random coil conformation and thereby can mediate an increased in vivo and/or in vitro stability to a recombinant protein of the disclosure, and has procoagulant activity.

Non-limiting examples of the PAS peptides are disclosed in, e.g., US Pat. Publ. No. 2010/0292130 A1; PCT Appl. Publ. No. WO 2008/155134 A1; and European issued patent EP2173890.

III.C.5. HAP

In certain aspects, a chimeric polypeptide used in the methods of the present disclosure comprises at least one homo-amino acid polymer (HAP) peptide or fragment, variant, or derivative thereof. A HAP peptide can comprise a repetitive sequence of glycine, which has at least 50 amino acids, at least 100 amino acids, 120 amino acids, 140 amino acids, 160 amino acids, 180 amino acids, 200 amino acids, 250 amino acids, 300 amino acids, 350 amino acids, 400 amino acids, 450 amino acids, or 500 amino acids in length. A HAP sequence is capable of extending half-life of a moiety fused to or linked to the HAP sequence. Non-limiting examples of the HAP sequence includes, but are not limited to (Gly)n, (Gly4Ser)n or S(Gly4Ser)n, wherein n is 1, 2, 3, 4, 5, 6, 7, 8, 9, 10, 11, 12, 13, 14, 15, 16, 17, 18, 19, or 20. In some embodiments, n is 20, 21, 22, 23, 24, 25, 26, 26, 28, 29, 30, 31, 32, 33, 34, 35, 36, 37, 38, 39, or 40. In other embodiments, n is 50, 60, 70, 80, 90, 100, 110, 120, 130, 140, 150, 160, 170, 180, 190, or 200. See, e.g., Schlapschy M et al., Protein Eng. Design Selection, 20: 273-284 (2007).

III.C.6. Transferrin

In certain aspects, a chimeric polypeptide used in the methods of the present disclosure comprises at least one transferrin peptide or fragment, variant, or derivative thereof. Any transferrin can fuse with the chimeric polypeptide used in the methods of the present disclosure. As an example, wild-type human Tf (Tf) is a 679 amino acid protein, of approximately 75 kDa (not accounting for glycosylation), with two main domains, N (about 330 amino acids) and C (about 340 amino acids), which appear to originate from a gene duplication. See GenBank accession numbers NM001063, XM002793, M12530, XM039845, XM 039847 and S95936 (www.ncbi.nlm.nih.gov), all of which are herein incorporated by reference in their entirety.

Transferrin transports iron through transferrin receptor (TfR)-mediated endocytosis. After the iron is released into an endosomal compartment and Tf-TfR complex is recycled to cell surface, the Tf is released back extracellular space for next cycle of iron transporting. Tf possesses a long half-life that is in excess of 14-17 days (Li et al., Trends Pharmacol. Sci. 23:206-209 (2002)). Transferrin fusion proteins have been studied for half-life extension, targeted deliver for cancer therapies, oral delivery and sustained activation of proinsulin (Brandsma et al., Biotechnol. Adv., 29: 230-238 (2011); Bai et al., Proc. Natl. Acad. Sci. USA 102:7292-7296 (2005); Kim et al., J. Pharmacol. Exp. Ther., 334:682-692 (2010); Wang et al., J. Controlled Release 155:386-392 (2011)).

III.C.7. PEG

In certain aspects, a chimeric polypeptide used in the methods of the present disclosure comprises at least one attachment site for a non-polypeptide heterologous moiety or fragment, variant, or derivative thereof. For example, a chimeric polypeptide used in the methods of the present disclosure can include one or more polyethylene glycol (PEG) moieties attached to one or more amino acid residues in the clotting factor and/or the Fc region.

PEGylation of a protein can refer to a conjugate formed between the protein and at least one polyethylene glycol (PEG) molecule. PEG is commercially available in a large variety of molecular weights and average molecular weight ranges. Typical examples of PEG average molecular weight ranges include, but are not limited to, about 200, about 300, about 400, about 600, about 1000, about 1300-1600, about 1450, about 2000, about 3000, about 3000-3750, about 3350, about 3000-7000, about 3500-4500, about 5000-7000, about 7000-9000, about 8000, about 10000, about 8500-11500, about 16000-24000, about 35000, about 40000, about 60000, and about 80000 Daltons. These average molecular weights are provided merely as examples and are not meant to be limiting in any way.

A chimeric polypeptide used in the methods of the present disclosure can be PEGylated to include mono- or poly-(e.g., 2-4) PEG moieties. PEGylation can be carried out by any of the PEGylation reactions known in the art. Methods for preparing a PEGylated protein product will generally include (i) reacting a polypeptide with polyethylene glycol (such as a reactive ester or aldehyde derivative of PEG) under conditions whereby the peptide of the disclosure becomes attached to one or more PEG groups; and (ii) obtaining the reaction product(s). In general, the optimal reaction conditions for the reactions will be determined case by case based on known parameters and the desired result.

There are a number of PEG attachment methods available to those skilled in the art, for example Malik F et al., Exp. Hematol. 20:1028-35 (1992); Francis, Focus on Growth Factors 3(2):4-10 (1992); European Pat. Pub. Nos. EP0401384, EP0154316, and EP0401384; and International Pat. Appl. Pub. Nos. WO92/16221 and WO95/34326. As a non-limiting example, FVIII variants can contain cysteine substitutions, and the cysteines can be further conjugated to PEG polymer. See Mei et al., Blood 116:270-279 (2010) and U.S. Pat. No. 7,632,921, which are incorporated herein by reference in their entireties.

In certain embodiments, the chimeric polypeptide comprises a single chain FVIII polypeptide covalently linked to a VWF fragment comprising a D' domain and a D3 domain of VWF, wherein the FVIII polypeptide comprises a deletion of all or a portion of the B domain, wherein the FVIII polypeptide is pegylated, and wherein the VWF fragment is fused directly or indirectly to the N-terminus of the FVIII polypeptide (e.g., PEG-scFVIII-D'D3, "MG1121," or LAFATE). In other embodiments, the chimeric polypeptide comprises a single chain FVIII polypeptide covalently linked to a VWF fragment comprising a D' domain and a D3 domain of VWF, wherein the FVIII polypeptide comprises a deletion of all or a portion of the B domain, wherein the VWF fragment is pegylated, and wherein the VWF fragment is fused directly or indirectly to the N-terminus of the FVIII polypeptide (e.g., scFVIII-D'D3-PEG). In other embodiments, the chimeric polypeptide comprises a single chain FVIII polypeptide covalently linked to a VWF fragment comprising a D' domain and a D3 domain of VWF, wherein the FVIII polypeptide comprises a deletion of all or a portion of the B domain, wherein FVIII polypeptide and the VWF fragment are pegylated, and wherein the VWF fragment is fused directly or indirectly to the N-terminus of the FVIII polypeptide (e.g., scFVIII-D'D3-PEG).

III.C.8. HES

In certain aspects, a chimeric polypeptide used in the methods of the present disclosure comprises at least one hydroxyethyl starch (HES) polymer. HES is a derivative of naturally occurring amylopectin and is degraded by alpha-amylase in the body. HES exhibits advantageous biological properties and is used as a blood volume replacement agent and in hemodilution therapy in the clinics. See, e.g., Sommermeyer et al., Krankenhauspharmazie 8:271-278 (1987); and Weidler et al., Arzneim.-Forschung/Drug Res. 41: 494-498 (1991).

HES is mainly characterized by the molecular weight distribution and the degree of substitution. HES has a mean molecular weight (weight mean) of from 1 to 300 kD, from 2 to 200 kD, from 3 to 100 kD, or from 4 to 70 kD. Hydroxyethyl starch can further exhibit a molar degree of substitution of from 0.1 to 3, from 0.1 to 2, from 0.1 to 0.9, or from 0.1 to 0.8, and a ratio between C2:C6 substitution in the range of from 2 to 20 with respect to the hydroxyethyl groups. HES with a mean molecular weight of about 130 kD is VOLUVEN® from Fresenius. VOLUVEN® is an artificial colloid, employed, e.g., for volume replacement used in the therapeutic indication for therapy and prophylaxis of hypovolaemia. There are a number of HES attachment methods available to those skilled in the art, e.g., the same PEG attachment methods described above.

III.C.9. PSA

In certain aspects, a chimeric polypeptide used in the methods of the present disclosure comprises at least one polysialic acid (PSA) polymer. PSAs are naturally occurring unbranched polymers of sialic acid produced by certain bacterial strains and in mammals in certain cells. See, e.g., Roth J. et al. (1993) in Polysialic Acid: From Microbes to Man, eds. Roth J., Rutishauser U., Troy F. A. (BirkhauserVerlag, Basel, Switzerland), pp. 335-348. PSAs can be produced in various degrees of polymerization from n=about 80 or more sialic acid residues down to n=2 by limited acid hydrolysis or by digestion with neuraminidases, or by fractionation of the natural, bacterially derived forms of the polymer. There are a number of PSA attachment methods available to those skilled in the art, e.g., the same PEG attachment methods described above. In certain aspects, an activated PSA can also be attached to a cysteine amino acid residue within the clotting factor, e.g., on FVIII, or within the Fc region. See, e.g., U.S. Pat. No. 5,846,951.

III.C.10. Clearance Receptors

In certain aspects, the half-life of a chimeric polypeptide used in the methods of the present disclosure can be extended where the clotting factor of the chimeric polypeptide comprises a FVIII polypeptide and at least one fragment of a FVIII clearance receptor or FVIII-binding fragment, variant, or derivative thereof. Insertion of soluble forms of clearance receptors, such as the low-density lipoprotein-related protein receptor LRP1, or fragments thereof, can block binding of FVIII to clearance receptors and thereby extend its half-life, e.g., in vivo half-life. LRP1 is a 600 kDa integral membrane protein that is implicated in the receptor-mediate clearance of a variety of proteins, including FVIII. See, e.g., Lenting et al., Haemophilia 16:6-16 (2010). Other suitable FVIII clearance receptors are, e.g., LDLR (low-density lipoprotein receptor), VLDLR (very low-density lipoprotein receptor), and megalin (LRP-2), or fragments thereof. See, e.g., Bovenschen et al., Blood 106:906-912 (2005); Bovenschen, Blood 116:5439-5440 (2010); Martinelli et al., Blood 116:5688-5697 (2010).

III.D. Insertion Sites

In some aspects, the insertion site in the FVIII polypeptide is located in one or more domains of the FVIII polypeptide, which is the N-terminus, the A1 domain, the A2 domain, the A3 domain, the B domain, the C1 domain, the C2 domain, the C-terminus, or two or more combinations thereof or between two domains of the FVIII polypeptide, which are the A1 domain and a1 acidic region, and the a1 acidic region and A2 domain, the A2 domain and a2 acidic region, the a2 acidic region and B domain, the B domain and A3 domain, and the A3 domain and C1 domain, the C1 domain and C2 domain, or any combinations thereof. For example, the insertion sites in which the XTEN sequence can be inserted are selected from the group consisting of the N-terminus and A1 domain, the N-terminus and A2 domain, the N-terminus and A3 domain, the N-terminus and B domain, the N-terminus and C1 domain, the N-terminus and C2 domain, the N-terminus and the C-terminus, the A1 and A2 domains, the A1 and A3 domains, the A1 and B domains, the A1 and C1 domains, the A1 and C2 domains, the A1 domain and the C-terminus, the A2 and A3 domains, the A2 and B domains, the A2 and C1 domains, the A2 and C2 domains, the A2 domain and the C-terminus, the A3 and B domains, the A3 and C1 domains, the A3 and C2 domains, the A3 domain and the C-terminus, the B and C1 domains, the B and C2 domains, the B domain and the C-terminus, the C1 and C2 domains, the C1 and the C-terminus, the C2 domain, and the C-terminus, and two or more combinations thereof.

The FVIII polypeptide, in which the XTEN sequence is inserted immediately downstream of one or more amino acids (e.g., one or more XTEN insertion sites) in the FVIII polypeptide or linked at the C-terminus or the N-terminus, retains the FVIII activity after linkage to or insertion by the XTEN sequence. The XTEN sequence can be inserted in the FVIII polypeptide once or more than once, twice, three times, four times, five times, or six times such that the insertions do not affect the FVIII activity (i.e., the FVIII protein still retains the coagulation property).

The FVIII polypeptide useful in the present disclosure can be linked to one or more XTEN polypeptides at the N-terminus or C-terminus of the FVIII polypeptide by an optional linker or inserted immediately downstream of one or more amino acids (e.g., one or more XTEN insertion sites) in the FVIII polypeptide by one or more optional linkers.

In yet other embodiments, one or more XTENs are inserted in the B domain of FVIII. In one example, an XTEN is inserted between amino acids 740 and 1640 corresponding to SEQ ID NO: 65, wherein the FVIII sequence between amino acids 740 and 1640 is optionally not present. In another example, an XTEN is inserted between amino acids 741 and 1690 corresponding to SEQ ID NO: 65, wherein the FVIII sequence between amino acids 740 and 1690 is optionally not present. In other examples, an XTEN is inserted between amino acids 741 and 1648 corresponding to SEQ ID NO: 65, wherein the FVIII sequence between amino acids 741 and 1648 is optionally not present. In yet other examples, an XTEN is inserted between amino acids 743 and 1638 corresponding to SEQ ID NO: 65, wherein the FVIII sequence between amino acids 743 and 1638 is optionally not present. In still other examples, an XTEN is inserted between amino acids 745 and 1656 corresponding to SEQ ID NO: 65, wherein the FVIII sequence between amino acids 745 and 1656 is optionally not present. In some examples, an XTEN is inserted between amino acids 745 and 1657 corresponding to SEQ ID NO: 65, wherein the FVIII sequence between amino acids 745 and 1657 is optionally not present. In certain examples, an XTEN is inserted between amino acids 745 and 1667 corresponding to SEQ ID NO: 65, wherein the FVIII sequence between amino acids 745 and 1667 is optionally not present. In still other examples, an XTEN is inserted between amino acids 745 and 1686 corresponding to SEQ ID NO: 65, wherein the FVIII sequence between amino acids 745 and 1686 is optionally not present. In some other examples, an XTEN is inserted between amino acids 747 and 1642 corresponding to SEQ ID NO: 65, wherein the FVIII sequence between amino acids 747 and 1642 is optionally not present. In still other examples, an XTEN is inserted between amino acids 751 and 1667 corresponding to SEQ ID NO: 65, wherein the FVIII sequence between amino acids 751 and 1667 is optionally not present. In some embodiments, an XTEN sequence is inserted between amino acids 745 and 746 of a mature FVIII polypeptide or the corresponding insertion site of the B-domain deleted FVIII polypeptide. In a particular embodiment, an XTEN sequence comprising an amino acid sequence having at least about 70%, at least about 75%, at least about 80%, at least about 85%, at least about 90%, at least about 95%, at least about 96%, at least about 97%, at least about 98%, at least about 99%, or about 100% sequence identity to the amino acid sequence of AE288 (SEQ ID NO: 8) is inserted between amino acids 745 and 746 of a mature FVIII, wherein the mature FVIII has a deletion of amino acid residues 746-1648. In particular embodiments, the XTEN is inserted immediately downstream of amino acid 745 of the B domain deleted FVIII of Table 5 (SEQ ID NO: 68).

III.E. Linkers

In certain embodiments, the chimeric polypeptide of the present disclosure further comprises one or more linkers in the FVIII protein and/or in the VWF fragment. One type of the linkers is a cleavable linker, which can be cleaved by various proteases when administered to a subject in vivo, e.g., at a site of coagulation. In some embodiments, the cleavable linker allows cleavage of moiety, e.g., a VWF protein, from the XTEN sequence, thus from the chimeric polypeptide at the site of the coagulation cascade, thereby allowing activated FVIII (FVIIIa) to have its FVIIIa activity. Another type of the linkers is a processable linker, which contains an intracellular cleavage site and thus can be cleaved by an intracellular processing enzyme in a host cell, allowing convenient expression of a polypeptide and formation of a chimeric polypeptide.

One or more linkers can be present between any two proteins in the chimeric polypeptide. In some embodiments, a chimeric polypeptide comprises a first polypeptide which comprises (i) a FVIII polypeptide and (ii) a first Ig constant region or a portion thereof and a second polypeptide which comprises (iii) a VWF protein, (iv) a linker (e.g., a cleavable linker), (v) an XTEN sequence, and (vi) a second Ig constant region or a portion thereof. In other embodiments, a chimeric polypeptide comprises a first polypeptide which comprises (i) a FVIII polypeptide and (ii) a first Ig constant region or a portion thereof and a second polypeptide which comprises (iii) a VWF protein, (iv) an XTEN sequence, (v) a linker (e.g., a cleavable linker), and (vi) a second Ig constant region or a portion thereof. In other embodiments, a chimeric polypeptide comprises a first polypeptide which comprises (i) a FVIII polypeptide and (ii) a first Ig constant region or a portion thereof and a second polypeptide which comprises (iii) a VWF protein, (iv) a first linker (e.g., a cleavable linker), (v) an XTEN sequence, (vi) a second linker (e.g., a cleavable linker), and (vii) a second Ig constant region or a portion thereof. In some embodiments, the first polypeptide further comprises a linker, e.g., a cleavable linker between the FVIII polypeptide and the first Ig constant region.

In certain embodiments, a chimeric polypeptide comprises a single chain comprising (i) a FVIII polypeptide, (ii) a first Ig constant region or a portion thereof, (iii) a linker (e.g., a processable linker), (iv) a VWF protein, (v) an XTEN sequence, and (vi) a second Ig constant region or a portion thereof. In other embodiments, a chimeric polypeptide comprises a single chain comprising (i) a FVIII polypeptide, (ii) a first Ig constant region or a portion thereof, (iii) a first linker (e.g., a processable linker), (iv) a VWF protein, (v) a second linker (e.g., a cleavable linker), (vi) an XTEN sequence, and (vii) a second Ig constant region or a portion thereof. The processable linker can be processed after the chimeric polypeptide is expressed in the host cell; thus the chimeric polypeptide produced in the host cell can be in the final form comprising two or three polypeptide chains.

The linker useful in the present disclosure can comprise any organic molecule. Example of linkers that can be used in the chimeric polypeptides of the present disclosure are disclosed, for example, in US 2011/0183907 A1, US 2016/0229903 A1, and US 2016/0251408 A1, each of which is incorporated by reference herein in its entirety. In some embodiments, the linker comprises a polymer, e.g., polyethylene glycol (PEG) or hydroxyethyl starch (HES). In other embodiments, the linker comprises an amino acids sequence. The linker can comprise at least about 10, 20, 30, 40, 50, 60, 70, 80, 90, 100, 150, 200, 300, 400, 500, 600, 700, 800, 900, 1000, 1100, 1200, 1300, 1400, 1500, 1600, 1700, 1800, 1900, or 2000 amino acids. The linker can comprise 1-5 amino acids, 1-10 amino acids, 1-20 amino acids, 10-50 amino acids, 50-100 amino acids, 100-200 amino acids, 200-300 amino acids, 300-400 amino acids, 400-500 amino acids, 500-600 amino acids, 600-700 amino acids, 700-800 amino acids, 800-900 amino acids, or 900-1000 amino acids. In some embodiments, the linker comprises an XTEN sequence. Additional examples of XTEN can be used according to the present disclosure and are disclosed in US Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, or WO 2011028344 A2. In other embodiments, the linker is a PAS sequence.

In certain embodiments, the linker is a polymer, e.g., polyethylene glycol (PEG) or hydroxyethyl starch (HES). In other embodiments, the linker is an amino acid sequence. The linker can comprise at least about 10, 20, 30, 40, 50, 60, 70, 80, 90, 100, 150, 200, 300, 400, 500, 600, 700, 800, 900, 1000, 1100, 1200, 1300, 1400, 1500, 1600, 1700, 1800, 1900, or 2000 amino acids. The linker can comprise 1-5 amino acids, 1-10 amino acids, 1-20 amino acids, 10-50 amino acids, 50-100 amino acids, 100-200 amino acids, 200-300 amino acids, 300-400 amino acids, 400-500 amino acids, 500-600 amino acids, 600-700 amino acids, 700-800 amino acids, 800-900 amino acids, or 900-1000 amino acids.

Examples of linkers are well known in the art. In certain embodiments, the linker comprises the sequence $G_n$. The linker can comprise the sequence $(GA)_n$. The linker can comprise the sequence $(GGS)_n$. In other embodiments, the linker comprises $(GGGS)_n$ (SEQ ID NO: 101). In still other embodiments, the linker comprises the sequence $(GGS)_n$ $(GGGGS)_n$ (SEQ ID NO: 95). In these instances, n can be an integer from 1-100. In other instances, n can be an integer from 1-20, i.e., 1, 2, 3, 4, 5, 6, 7, 8, 9, 10, 11, 12, 13, 14, 15, 16, 17, 18, 19, or 20. Examples of linkers include, but are not limited to, GGG, SGGSGGS (SEQ ID NO: 96), GGSGGSGGSGGSGGG (SEQ ID NO: 97), GGSGGSGGGGSGGGGS (SEQ ID NO: 98), GGSGGSGGSGGSGGSGGS (SEQ ID NO: 99), or GGGGSGGGGSGGGGS (SEQ ID NO: 100). The linker does not eliminate or diminish the VWF protein activity or the clotting activity of Factor VIII. Optionally, the linker enhances the VWF protein activity or the clotting activity of Factor VIII protein, e.g., by further diminishing the effects of steric hindrance and making the VWF protein or Factor VIII portion more accessible to its target binding site.

In certain embodiments, the linker useful for the chimeric polypeptide is 15-25 amino acids long. In other embodiments, the linker useful for the chimeric polypeptide is 15-20 amino acids long. In some embodiments, the linker for the chimeric polypeptide is 10-25 amino acids long. In other embodiments, the linker for the chimeric polypeptide is 15 amino acids long. In still other embodiments, the linker for the chimeric polypeptide is (GGGGS)$_n$ (SEQ ID NO: 94) where G represents glycine, S represents serine and n is an integer from 1-20.

III.F. Cleavage Sites

A cleavable linker can incorporate a moiety capable of being cleaved either chemically (e.g., hydrolysis of an ester bond), enzymatically (i.e., incorporation of a protease cleavage sequence), or photolytically (e.g., a chromophore such as 3-amino-3-(2-nitrophenyl) proprionic acid (ANP)) in order to release one molecule from another. Examples of cleavable linkers suitable for the chimeric polypeptide of the present disclosure can be found, for example, in US 2016/0229903 A1 and US 2016/0251408 A1, each of which is incorporated by reference herein in its entirety.

In certain embodiments, a cleavable linker comprises one or more cleavage sites at the N-terminus or C-terminus or both. In other embodiments, the cleavable linker consists essentially of or consists of one or more cleavable sites. In other embodiments, the cleavable linker comprises heterologous amino acid linker sequences described herein or polymers and one or more cleavable sites.

In certain embodiments, a cleavable linker comprises one or more cleavage sites that can be cleaved in a host cell (i.e., intracellular processing sites). Non limiting examples of the cleavage site include RRRR (SEQ ID NO: 102), RKRRKR (SEQ ID NO: 103), and RRRRS (SEQ ID NO: 104).

In some embodiments, a cleavable linker comprises an a1 region from FVIII, an a2 region from FVIII, an a3 region from FVIII, a thrombin cleavable site which comprises X-V-P-R (SEQ ID NO: 105) and a PAR1 exosite interaction motif, wherein X is an aliphatic amino acid, or any combinations thereof. comprises the a2 region which comprises an amino acid sequence at least about 80%, about 85%, about 90%, about 95%, or 100% identical to Glu720 to Arg740 corresponding to full-length FVIII, wherein the a2 region is capable of being cleaved by thrombin. In particular embodiments, a cleavable linker useful for the disclosure comprises an a2 region which comprises ISDKNTGDYYEDSYEDIS-AYLLSKNNAIEPRSFS (SEQ ID NO: 106) or DKNTGDYYEDSYEDISAYLLSKNNAIEPRSFS (SEQ ID NO: 88). In other embodiments, a cleavable linker for the disclosure comprises the a1 region which comprises an amino acid sequence at least about 80%, about 85%, about 90%, about 95%, or 100% identical to Met337 to Arg372 corresponding to full-length FVIII, wherein the a1 region is capable of being cleaved by thrombin. In particular embodiments, the a1 region comprises ISMKNNEEAEDYDD-DLTDSEMDVVRFDDDNSPSFIQIRSV (SEQ ID NO: 107). In some embodiments, a cleavable linker of the disclosure comprises the a3 region which comprises an amino acid sequence at least about 80%, about 85%, about 90%, about 95%, or 100% identical to Glu1649 to Arg1689 corresponding to full-length FVIII, wherein the a3 region is capable of being cleaved by thrombin. In certain embodiments, a cleavable linker for the disclosure comprises an a3 region comprising ISEITRTTLQSDQEEIDYDDTIS-VEMKKEDFDIYDEDEN QSPRSFQ (SEQ ID NO: 108).

In other embodiments, a cleavable linker comprises the thrombin cleavage site which comprises X-V-P-R (SEQ ID NO: 105) and the PAR1 exosite interaction motif and wherein the PAR1 exosite interaction motif comprises S-F-L-L-R-N(SEQ ID NO: 109). The PAR1 exosite interaction motif can further comprise an amino acid sequence selected from P, P-N, P-N-D, P-N-D-K (SEQ ID NO: 110), P-N-D-K-Y (SEQ ID NO: 111), P-N-D-K-Y-E (SEQ ID NO: 112), P-N-D-K-Y-E-P (SEQ ID NO: 113), P-N-D-K-Y-E-P-F (SEQ ID NO: 114), P-N-D-K-Y-E-P-F-W (SEQ ID NO: 115), P-N-D-K-Y-E-P-F-W-E (SEQ ID NO: 116), P-N-D-K-Y-E-P-F-W-E-D (SEQ ID NO: 117), P-N-D-K-Y-E-P-F-W-E-D-E (SEQ ID NO: 118), P-N-D-K-Y-E-P-F-W-E-D-E-E (SEQ ID NO: 119), P-N-D-K-Y-E-P-F-W-E-D-E-E-S (SEQ ID NO: 120), or any combination thereof. In some embodiments, the aliphatic amino acid is selected from Glycine, Alanine, Valine, Leucine, or Isoleucine.

In other embodiments, a cleavable linker comprises one or more cleavage sites that are cleaved by a protease after a chimeric polypeptide comprising the cleavable linker is administered to a subject. In some embodiments, the cleavage site is cleaved by a protease selected from the group consisting of factor XIa, factor XIIa, kallikrein, factor VIIa, factor IXa, factor Xa, factor IIa (thrombin), Elastase-2, MMP-12, MMP-13, MMP-17, and MMP-20. In other embodiments, the cleavage site is selected from the group consisting of a FXIa cleavage site (e.g., KLTR↓AET (SEQ ID NO: 121)), a FXIa cleavage site (e.g, DFTR↓VVG (SEQ ID NO: 122)), a FXIIa cleavage site (e.g., TMTR↓IVGG (SEQ ID NO: 123)), a Kallikrein cleavage site (e.g., SPFR↓STGG (SEQ ID NO: 124)), a FVIIa cleavage site (e.g., LQVR↓IVGG (SEQ ID NO: 125)), a FIXa cleavage site (e.g., PLGR↓IVGG (SEQ ID NO: 126)), a FXa cleavage site (e.g., IEGR↓TVGG (SEQ ID NO: 127)), a FIIa (thrombin) cleavage site (e.g, LTPR↓SLLV (SEQ ID NO: 128)), a Elastase-2 cleavage site (e.g., LGPV↓SGVP (SEQ ID NO: 129)), a Granzyme-B cleavage (e.g., VAGD↓SLEE (SEQ ID NO: 130)), a MMP-12 cleavage site (e.g., GPAG↓LGGA (SEQ ID NO: 131)), a MMP-13 cleavage site (e.g., GPAG↓LRGA (SEQ ID NO: 132)), a MMP-17 cleavage site (e.g., APLG↓LRLR (SEQ ID NO: 133)), a MMP-20 cleavage site (e.g., PALP↓LVAQ (SEQ ID NO: 134)), a TEV cleavage site (e.g., ENLYFQ↓G (SEQ ID NO: 135)), a Enterokinase cleavage site (e.g., DDDK↓IVGG (SEQ ID NO: 136)), a Protease 3C (PRESCISSION™) cleavage site (e.g., LEVLFQ↓GP (SEQ ID NO: 137)), and a Sortase A cleavage site (e.g., LPKT↓GSES) (SEQ ID NO: 138). In certain embodiments, the FXIa cleavage sites include, but are not limited to, e.g., TQSFNDFTR (SEQ ID NO: 1) and SVSQTSKLTR (SEQ ID NO: 3). Non-limiting exemplary thrombin cleavage sites include, e.g., DFLAEGGGVR (SEQ ID NO: 4), TTKIKPR (SEQ ID NO: 5), LVPRG (SEQ ID NO: 6), DKNTGDYYEDSYEDISAYLLSKN-NAIEPRSFS (SEQ ID NO: 88), or IEPRSFS (SEQ ID NO: 194), and a sequence comprising, consisting essentially of, or consisting of ALRPR (SEQ ID NO: 7) (e.g., ALR-PRVVGGA (SEQ ID NO: 145)).

In some embodiments, the cleavage site is TLDPRSFLLRNPNDKYEPFWEDEEK (SEQ ID NO: 146). In other embodiments, the cleavage site comprises DKNTGDYYEDSYEDISAYLLSKNNAIEPRSFS (SEQ ID NO: 88) or a fragment thereof. In particular embodiments, the cleavage site comprises IEPRSFS (SEQ ID NO: 194). In other embodiments, the cleavage site comprises EPRSFS (SEQ ID NO: 195), wherein the cleavage site is not the full-length a2 region of FVIII. In still other embodiments, the cleavage site comprises IEPR (SEQ ID NO: 200). In yet other embodiments, the cleavage site comprises IEPR (SEQ ID NO: 200), wherein the cleavage site is not the full-length a2 region of FVIII or does not comprise the full-length a2 region of FVIII. In other embodiments, the cleavage site comprises DKNTGDYYEDSYEDISAYLL-SKNNAIEPRSFS (SEQ ID NO: 88), KNTGDYYEDSYE-DISAYLLSKNNAIEPRSFS (SEQ ID NO: 139), NTGDYYEDSYEDISAYLLSKNNAIEPRSFS (SEQ ID NO: 140), TGDYYEDSYEDISAYLLSKNNAIEPRSFS (SEQ ID NO: 141), GDYYEDSYEDISAYLLSKN-NAIEPRSFS (SEQ ID NO: 142), DYYEDSYEDISAYLL-SKNNAIEPRSFS (SEQ ID NO: 143), YYEDSYEDISAY-LLSKNNAIEPRSFS (SEQ ID NO: 144), YEDSYEDISAYLLSKNNAIEPRSFS (SEQ ID NO: 176), EDSYEDISAYLLSKNNAIEPRSFS (SEQ ID NO: 177), DSYEDISAYLLSKNNAIEPRSFS (SEQ ID NO: 178), SYEDISAYLLSKNNAIEPRSFS (SEQ ID NO: 179), YEDISAYLLSKNNAIEPRSFS (SEQ ID NO: 180), EDIS-AYLLSKNNAIEPRSFS (SEQ ID NO: 181), DISAYLL-SKNNAIEPRSFS (SEQ ID NO: 182), ISAYLLSKN-NAIEPRSFS (SEQ ID NO: 183), SAYLLSKNNAIEPRSFS (SEQ ID NO: 184), AYLLSKNNAIEPRSFS (SEQ ID NO: 185), YLLSKNNAIEPRSFS (SEQ ID NO: 186), LLSKN-NAIEPRSFS (SEQ ID NO: 187), LSKNNAIEPRSFS (SEQ ID NO: 188), SKNNAIEPRSFS (SEQ ID NO: 189), KNNAIEPRSFS (SEQ ID NO: 190), NNAIEPRSFS (SEQ ID NO: 191), NAIEPRSFS (SEQ ID NO: 192), AIEPRSFS (SEQ ID NO: 193), or IEPRSFS (SEQ ID NO: 194). In other embodiments, the cleavage site comprises DKNTGDYYEDSYEDISAYLLSKNNAIEPRSFS (SEQ ID NO: 88), KNTGDYYEDSYEDISAYLLSKN-NAIEPRSFS (SEQ ID NO: 139), NTGDYYEDSYEDIS-AYLLSKNNAIEPRSFS (SEQ ID NO: 140), TGDYYED-SYEDISAYLLSKNNAIEPRSFS (SEQ ID NO: 141), GDYYEDSYEDISAYLLSKNNAIEPRSFS (SEQ ID NO: 142), DYYEDSYEDISAYLLSKNNAIEPRSFS (SEQ ID NO: 143), YYEDSYEDISAYLLSKNNAIEPRSFS (SEQ ID NO: 144), YEDSYEDISAYLLSKNNAIEPRSFS (SEQ ID NO: 176), EDSYEDISAYLLSKNNAIEPRSFS (SEQ ID NO: 177), DSYEDISAYLLSKNNAIEPRSFS (SEQ ID NO: 178), SYEDISAYLLSKNNAIEPRSFS (SEQ ID NO: 179), YEDISAYLLSKNNAIEPRSFS (SEQ ID NO: 180), EDIS-AYLLSKNNAIEPRSFS (SEQ ID NO: 181), DISAYLL-SKNNAIEPRSFS (SEQ ID NO: 182), ISAYLLSKN-NAIEPRSFS (SEQ ID NO: 183), SAYLLSKNNAIEPRSFS (SEQ ID NO: 184), AYLLSKNNAIEPRSFS (SEQ ID NO: 185), YLLSKNNAIEPRSFS (SEQ ID NO: 186), LLSKN-NAIEPRSFS (SEQ ID NO: 187), LSKNNAIEPRSFS (SEQ ID NO: 188), SKNNAIEPRSFS (SEQ ID NO: 189), KNNAIEPRSFS (SEQ ID NO: 190), NNAIEPRSFS (SEQ ID NO: 191), NAIEPRSFS (SEQ ID NO: 192), AIEPRSFS (SEQ ID NO: 193), or IEPRSFS (SEQ ID NO:194), wherein the cleavage site is not the full-length FVIII a2 region. In certain embodiments the cleavable linker is cleavable in a thrombin cleavage assay as provided herein or as known in the art.

In particular embodiments, the chimeric polypeptide of the present disclosure comprises: (i) a FVIII protein comprising a FVIII polypeptide, a first XTEN sequence, and a first Fc region; and (ii) a VWF fragment comprising a D' domain of VWF and a D3 domain of VWF, a second XTEN sequence, an a2 linker of FVIII, and a second Fc region; wherein:
  (a) the FVIII protein has a deletion of amino acids 746 to 1648 corresponding to mature FVIII;
  (b) the first XTEN sequence is inserted within the FVIII polypeptide immediately downstream of amino acid 745 corresponding to mature FVIII;
  (c) the first XTEN sequence comprises an amino acid sequence having at least about 70%, at least about 75%, at least about 80%, at least about 85%, at least about 90%, at least about 95%, at least about 96%, at least about 97%, at least about 98%, at least about 99%, or about 100% sequence identity to the amino acid sequence of AE288 (SEQ ID NO: 8);
  (d) the first Fc region is fused to the C-terminus of the FVIII polypeptide;
  (e) the second XTEN sequence is fused to the C-terminus of the VWF fragment;
  (f) the second XTEN sequence comprises an amino acid sequence having at least about 70%, at least about 75%, at least about 80%, at least about 85%, at least about 90%, at least about 95%, at least about 96%, at least about 97%, at least about 98%, at least about 99%, or about 100% sequence identity to the amino acid sequence of AE144_5A (SEQ ID NO: 58);
  (g) the a2 linker is fused to the C-terminus of the XTEN;
  (h) the a2 linker comprises an amino acid sequence having at least about 70%, at least about 75%, at least about 80%, at least about 85%, at least about 90%, at least about 95%, at least about 96%, at least about 97%, at least about 98%, at least about 99%, or about 100% sequence identity to the amino acid sequence of SEQ ID NO: 88;
  (i) the second Fc region is fused to the C-terminus of the a2 linker; and
  (j) the first Fc region is covalently linked to the second Fc region by a disulfide bond.

In particular embodiments, a chimeric polypeptide of the disclosure comprises two polypeptide sequences, a first polypeptide sequence comprising an amino acid sequence at least about 80%, 90%, 95%, or 100% identical to a sequence selected from FVIII-161 (SEQ ID NO: 69), FVIII-169 (SEQ ID NO: 70), FVIII-170 (SEQ ID NO: 71), FVIII-173 (SEQ ID NO: 72); FVIII-195 (SEQ ID NO: 73); FVIII-196 (SEQ ID NO: 74), FVIII199 (SEQ ID NO: 75), FVIII-201 (SEQ ID NO: 76); FVIII-203 (SEQ ID NO: 77), FVIII-204 (SEQ ID NO: 78), FVIII-205 (SEQ ID NO: 79), FVIII-266 (SEQ ID NO: 80), FVIII-267 (SEQ ID NO: 81), FVIII-268 (SEQ ID NO: 82), FVIII-269 (SEQ ID NO: 83), FVIII-271 (SEQ ID NO: 84) or FVIII-272 (SEQ ID NO: 85) and a second polypeptide sequence comprising an amino acid sequence at least about 80%, 90%, 95%, or 100% identical to a sequence selected from VWF031 (SEQ ID NO: 86), VWF034 (SEQ ID NO: 87), or VWF-036.

In some embodiments, the chimeric polypeptide of the disclosure comprises two polypeptide sequences, a first polypeptide sequence comprising an amino acid sequence at least about 80%, 90%, 95%, or 100% identical to the amino acid sequence set forth in SEQ ID NO: 201; and a second polypeptide sequence comprising a VWF fragment comprising a D' domain of VWF and a D3 domain of VWF and an Fc region. In some embodiments, the chimeric polypeptide of the disclosure comprises two polypeptide sequences, a first polypeptide sequence comprising FVIII polypeptide and an Fc region; and a second polypeptide sequence comprising an amino acid sequence at least about 80%, 90%, 95%, or 100% identical to the amino acid sequence set forth in SEQ ID NO: 202. In certain embodiments, the chimeric polypeptide of the disclosure comprises two polypeptide sequences, a first polypeptide sequence comprising an amino acid sequence at least about 80%, 90%, 95%, or 100% identical to the amino acid sequence set forth in SEQ ID NO: 201 and a second polypeptide sequence comprising an amino acid sequence at least about 80%, 90%, 95%, or 100% identical to the amino acid sequence set forth in SEQ ID NO: 202. In particular embodiments, the chimeric polypeptide of the disclosure comprises two polypeptide sequences, a first polypeptide sequence comprising the amino acid sequence set forth in SEQ ID NO: 201 and a second polypeptide sequence comprising the amino acid sequence set forth in SEQ ID NO: 202. In other particular embodiments, the chimeric polypeptide of the disclosure comprises two polypeptide sequences, a first polypeptide sequence comprising the amino acid sequence set forth in SEQ ID NO: 201 and a second polypeptide sequence comprising the amino acid sequence set forth in SEQ ID NO: 202, wherein the first polypeptide sequence and the second polypeptide sequence are linked to each other by a disulphide bond.

IV. Pharmaceutical Compositions

Compositions containing the chimeric polypeptide of the present disclosure can contain a suitable pharmaceutically acceptable carrier. For example, they can contain excipients and/or auxiliaries that facilitate processing of the active compounds into preparations designed for delivery to the site of action.

The pharmaceutical composition can be formulated for parenteral administration (i.e. intravenous, subcutaneous, or intramuscular) by bolus injection. Formulations for injection can be presented in unit dosage form, e.g., in ampoules or in multidose containers with an added preservative. The compositions can take such forms as suspensions, solutions, or emulsions in oily or aqueous vehicles, and contain formulatory agents such as suspending, stabilizing and/or dispersing agents. Alternatively, the active ingredient can be in powder form for constitution with a suitable vehicle, e.g., pyrogen free water.

Suitable formulations for parenteral administration also include aqueous solutions of the active compounds in water-soluble form, for example, water-soluble salts. In addition, suspensions of the active compounds as appropriate oily injection suspensions can be administered. Suitable lipophilic solvents or vehicles include fatty oils, for example, sesame oil, or synthetic fatty acid esters, for example, ethyl oleate or triglycerides. Aqueous injection suspensions can contain substances, which increase the viscosity of the suspension, including, for example, sodium carboxymethyl cellulose, sorbitol and dextran. Optionally, the suspension can also contain stabilizers. Liposomes also can be used to encapsulate the molecules of the disclosure for delivery into cells or interstitial spaces. Exemplary pharmaceutically acceptable carriers are physiologically compatible solvents, dispersion media, coatings, antibacterial and antifungal agents, isotonic and absorption delaying agents, water, saline, phosphate buffered saline, dextrose, glycerol, ethanol and the like. In some embodiments, the composition comprises isotonic agents, for example, sugars, polyalcohols such as mannitol, sorbitol, or sodium chloride. In other embodiments, the compositions comprise pharmaceutically acceptable substances such as wetting agents or minor amounts of auxiliary substances such as wetting or emulsifying agents, preservatives or buffers, which enhance the shelf life or effectiveness of the active ingredients.

Compositions of the disclosure can be in a variety of forms, including, for example, liquid (e.g., injectable and infusible solutions), dispersions, suspensions, semi-solid and solid dosage forms. The preferred form depends on the mode of administration and therapeutic application.

The composition can be formulated as a solution, micro emulsion, dispersion, liposome, or other ordered structure suitable to high drug concentration. Sterile injectable solutions can be prepared by incorporating the active ingredient in the required amount in an appropriate solvent with one or a combination of ingredients enumerated above, as required, followed by filtered sterilization. Generally, dispersions are prepared by incorporating the active ingredient into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

The active ingredient can be formulated with a controlled-release formulation or device. Examples of such formulations and devices include implants, transdermal patches, and microencapsulated delivery systems. Biodegradable, biocompatible polymers can be used, for example, ethylene vinyl acetate, polyanhydrides, polyglycolic acid, collagen, polyorthoesters, and polylactic acid. Methods for the preparation of such formulations and devices are known in the art. See e.g., Sustained and Controlled Release Drug Delivery Systems, J. R. Robinson, ed., Marcel Dekker, Inc., New York, 1978.

Injectable depot formulations can be made by forming microencapsulated matrices of the drug in biodegradable polymers such as polylactide-polyglycolide. Depending on the ratio of drug to polymer, and the nature of the polymer employed, the rate of drug release can be controlled. Other exemplary biodegradable polymers are polyorthoesters and polyanhydrides. Depot injectable formulations also can be prepared by entrapping the drug in liposomes or microemulsions.

Supplementary active compounds can be incorporated into the compositions. In some embodiments, the chimeric polypeptide of the disclosure is formulated with another clotting factor, or a variant, fragment, analogue, or derivative thereof. For example, the clotting factor includes, but is not limited to, factor V, factor VII, factor VIII, factor IX, factor X, factor XI, factor XII, factor XIII, prothrombin, fibrinogen, von Willebrand factor or recombinant soluble tissue factor (rsTF) or activated forms of any of the preceding. The clotting factor of hemostatic agent can also include anti-fibrinolytic drugs, e.g., epsilon-amino-caproic acid, tranexamic acid.

Dosage regimens can be adjusted to provide the optimum desired response. For example, a single bolus can be administered, several divided doses can be administered over time, or the dose can be proportionally reduced or increased as indicated by the exigencies of the therapeutic situation. It is advantageous to formulate parenteral compositions in dosage unit form for ease of administration and uniformity of dosage. See, e.g., Remington's Pharmaceutical Sciences (Mack Pub. Co., Easton, Pa. 1980).

In addition to the active compound, the liquid dosage form can contain inert ingredients such as water, ethyl alcohol, ethyl carbonate, ethyl acetate, benzyl alcohol, benzyl benzoate, propylene glycol, 1,3-butylene glycol, dimethylformamide, oils, glycerol, tetrahydrofurfuryl alcohol, polyethylene glycols, and fatty acid esters of sorbitan.

Non-limiting examples of suitable pharmaceutical carriers are also described in Remington's Pharmaceutical Sciences by E. W. Martin. Some examples of excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol, and the like. The composition can also contain pH buffering reagents, and wetting or emulsifying agents.

In some embodiments, a pharmaceutical composition comprises a chimeric polypeptide and a pharmaceutically acceptable carrier. The FVIII protein in a chimeric polypeptide has extended half-life compared to wild type FVIII protein or the corresponding FVIII protein without the VWF fragment. In some embodiments, wherein the half-life of the chimeric polypeptide is extended at least about 1.5 times, at least about 2 times, at least about 2.5 times, at least about 3 times, at least about 4 times, at least about 5 times, at least about 6 times, at least about 7 times, at least about 8 times, at least about 9 times, at least about 10 times, at least about 11 times, or at least about 12 times longer than wild type FVIII. In other embodiments, the half-life of Factor VIII is at least about 17 hours, at least about 18 hours, at least about 19 hours, at least about 20 hours, at least about 21 hours, at least about 22 hours, at least about 23 hours, at least about 24 hours, at least about 25 hours, at least about 26 hours, at least about 27 hours, at least about 28 hours, at least about 29 hours, at least about 30 hours, at least about 31 hours, at least about 32 hours, at least about 33 hours, at least about 34 hours, at least about 35 hours, at least about 36 hours, at least about 48 hours, at least about 60 hours, at least about 72 hours, at least about 84 hours, at least about 96 hours, or at least about 108 hours. In some embodiments, the half-life of the chimeric polypeptide is extended about 3 times compared to wild type FVIII.

In some embodiments, the composition is administered by parenteral administration, which can be intravenous or subcutaneous administration.

In other embodiments, the composition is used to treat a bleeding disease or condition in a subject in need thereof. The bleeding disease or condition is selected from the group consisting of a bleeding coagulation disorder, hemarthrosis, muscle bleed, oral bleed, hemorrhage, hemorrhage into muscles, oral hemorrhage, trauma, trauma capitis, gastrointestinal bleeding, intracranial hemorrhage, intra-abdominal hemorrhage, intrathoracic hemorrhage, bone fracture, central nervous system bleeding, bleeding in the retropharyngeal space, bleeding in the retroperitoneal space, bleeding in the illiopsoas sheath and any combinations thereof. In still other embodiments, the subject is scheduled to undergo a surgery. In yet other embodiments, the treatment is prophylactic or on-demand.

Having now described the present disclosure in detail, the same will be more clearly understood by reference to the following examples, which are included herewith for purposes of illustration only and are not intended to be limiting of the disclosure. All patents, publications, and articles referred to herein are expressly and specifically incorporated herein by reference.

EXAMPLES

Example 1: First in Human Study of FVIII-XTEN-Fc/D'D3-XTEN-Fc Heterodimers

Factor-based replacement therapy is the cornerstone of hemophilia care. Conventional recombinant FVIII (rFVIII) products have a short half-life, requiring frequent administration. Significant advances to patient care have been brought by rFVIIIFc (Eloctate®), including the longest dosing interval for hemophilia A; adequate bleed control, including prophylactically, in acute, perioperative, and emergency situations; protection beyond bleed control, including joint protection and improved quality of life; and long-term consistent and well-characterized safety profile. However, weekly or longer factor VIII prophylactic dosing still remains an unmet need for the majority of people with hemophilia A.

The present study investigates the safety and pharmacokinetics (PK) of rFVIIIFc-VWF-XTEN, a chimeric polypeptide comprising a (i) a FVIII polypeptide, an XTEN inserted within the B domain of the FVIII polypeptide, and a first Fc region; and (ii) a VWF fragment, a second XTEN sequence, an a2 linker, and a second Fc region (FIG. 1).

Study Design

The object of the present study was to assess the safety, tolerability, and FVIII activity (PK) of a single dose of rFVIIIFc-VWF-XTEN compared with rFVIII. The patient population included previously treated adult males with severe hemophilia A (<1 IU/dL [<1%] endogenous FVIII activity level) with at least 150 exposure days to FVIII products, and with no history of positive inhibitor test or clinical signs of decreased response to FVIII administration. The primary endpoints were adverse events and clinical abnormalities in laboratory tests, including development of inhibitors. Key secondary endpoints included pharmacokinetics parameters, including but not limited to elimination half-life (t½), clearance (CL), area under the curve from 0 to infinity ($AUC_{0-\infty}$), mean residence time (MRT), and incremental recovery (IR).

Patients were enrolled into a low-dose cohort (7 patients; FIG. 2A) or a high-dose cohort (9 patients; FIG. 2B). Each patient was dosed with rFVIII (ADVATE®) followed by a PK sampling period. Following a brief washout period (≤3 days for the low dose cohort (FIG. 2A) and ≤4 days for the high-dose cohort (FIG. 2B)), each subject was then administered rFVIIIFc-VWF-XTEN followed by a PK sampling period. Subjects underwent safety observation for 28 days following the injection of rFVIIIFc-VWF-XTEN, including sample collection for inhibitor assessments at 14 and 28 days after the injection of rFVIIIFc-VWF-XTEN. Patients in the low-dose cohort received 25 IU/kg of rFVIII and 25 IU/kg of rFVIIIFc-VWF-XTEN. Patients in the high-dose cohort received 65 IU/kg of rFVIII and 65 IU/kg of rFVIIIFc-VWF-XTEN.

Methods

Pharmacokinetc parameters were measured by a modified activated partial thromboplastin time (aPTT) clotting assay ("one stage" assay). Briefly, FVIII activity is measured in a modified aPTT assay using the Dade® Actin® FSL Activated PTT Reagent (Siemens Health Care Diagnostics) on a BCS® XP analyzer (Siemens Healthcare Diagnostics). 7-point calibration curves (High: 1.500-0.050 IU/mL; Low: 0.150-0.00251 U/mL) were prepared using a rFVIIIFc-VWF-XTEN specific calibrator. For the high calibration curve, the rFVIIIFc-VWF-XTEN calibrator [1.000 IU/mL] is diluted into Tris/BSA buffer (50 mM, 150 mM sodium chloride, pH 7.4+/−0.2, containing 1% BSA). This dilution is carried out by the BCS® XP analyzer to generate preselected calibration FVIII activity levels. These are then tested at the 1:2 working dilution prepared in Tris/BSA buffer. For the low calibration curve, the rFVIIIFc-VWF-XTEN calibrator [1.000 IU/mL] is diluted in immunodepleted FVIII deficient plasma (Siemens Healthcare Diagnostics) by the BCS® XP analyzer, and tested neat (in the absence of a working dilution). Calibration is performed in duplicate. Curves are plotted by FVIII activity in IU/mL (x-axis) and clotting time in seconds (y-axis). Both high and low calibration curves use a linear log-lin regression curve fit.

Samples are tested in duplicate using the high calibration curve metatest (1:2, 1:4, and 1:8 working dilutions in Tris/BSA) or the low calibration curve metatest (neat, 1:2, and 1:4 working dilutions I n immuno-depleted FVIII deficient plasma). After the appropriate working dilution, all calibrators, patient samples and quality control samples are mixed 1:1 with with immuno-depleted FVIII deficient plasma, containing less than or equal to 0.010 IU/mL FVIII activity and at least 0.400 IU/mL of the other clotting factors. After the samples are mixed with this plasma, the APTT reagent is added and the mixture is incubated. Following incubation, calcium chloride is added and the time to clot formation is measured optically. An algorithm then examines whether the individual working dilution results fall within +/−15.0% of the mean to determine reported FVIII activity. Minimum of two metatest working dilution results are necessary to determine the reported FVIII activity, except near the Lower Limit of Quantification (LLOQ).

Results: Low Dose Cohort

Seven subjects enrolled in the low dose cohort; one subject withdrew for reasons unrelated to the study prior to receiving rFVIIIFc-VWF-XTEN. Six subjects received a single, low dose of rFVIIIFc-VWF-XTEN (25 IU/kg). Characteristics of the first four subjects treated in the low dose cohort included: previously treated adult male subjects with severe hemophilia A (<1 IU/dL [<1%] endogenous FVIII activity level); all subjects were Caucasian; the age of the subjects ranged from 19-60 years, with an average age of 33; and the average weight was 85 kg (ranging from 67.2-100.6 kg).

In all patients, rFVIIIFc-VWF-XTEN was generally well tolerated, and no inhibitors were observed at Day 14 or Day 28 following dosing.

The average FVIII activity post-infusion for the first six subjects receiving a single low dose of rFVIIIFc-VWF-XTEN (25 IU/kg) at 5 days was about 12.0% and at 7 days was about 5.3% (FIG. 3A). Average FVIII activity remained above 1% through 10 days (FIG. 3A). Pharmacokinetic parameters, measured by activated partial thromboplastin time (aPTT) measurement, for rFVIIIFc-VWF-XTEN (25 IU/kg) and rFVIII (25 IU/kg) are shown in Table 9. rFVIIIFc-VWF-XTEN was observed to have an average half-life of about 37.6 hours in the human subjects, which was over 4-fold higher than the average half-life for rFVIII (about 9.12 hours) administered at the same dose.

TABLE 9

Pharmacokinetic (PK) Parameters for the Low-Dose Cohort

| PK Parameter | rFVIIIFc-VWF-XTEN Geometric Mean [Range] (N = 6) | rFVIII Geometric Mean [Range] (N = 7) | Mean Ratio [95% CI] |
|---|---|---|---|
| Half-life, h | 37.61 [33.28-42.50] | 9.12 [6.24-13.33] | 4.13 [2.94, 5.79] $P < 0.001$ |
| $C_{max}$ (IU/dL) | 70.1 [49.7-98.9] | 51.80 [43.3-61.9] | 1.35 [1.04, 1.77] $P = 0.032$ |
| AUC∞, h × IU/dL | 4470 [3280-6080] | 638 [495-822] | 7.00 [5.78, 8.48] $P < 0.001$ |
| MRT, h | 56.93 [49.19-65.89] | 12.54 [9.82-16.10] | 4.54 [3.64, 5.66] $P < 0.001$ |
| CL, mL/h/kg | 0.56 [0.41-0.76] | 3.91 [3.05-5.02] | 0.14 [0.12, 0.17] $P < 0.001$ |
| IR, IU/dL per IU/kg | 2.72 [1.95-3.80] | 2.00 [1.60-2.50] | 1.36 [0.98, 1.89] $P = 0.063$ |

Results: High Dose Cohort

Nine subjects were enrolled in the high dose cohort. The subjects were administered a single, high dose of rFVIIIFc-VWF-XTEN (65 IU/kg). One subject could not be tested for PK parameters due to reasons unrelated to the study. Characteristics of the subjects treated in the high dose cohort included: previously treated adult male subjects with severe hemophilia A (<1 IU/dL [<1%] endogenous FVIII activity level); 7 of 9 subjects were Caucasian; the age of the subjects ranged from 32-63 years, with an average age of 44; and the average weight was 81.1 kg (ranging from 61.5-100.7 kg).

The average FVIII activity post-infusion for the eight evaluated subjects receiving a single high dose of rFVIIIFc-VWF-XTEN (65 IU/kg) at 5 days was about 38.0% and at 7 days was about 17% (FIG. 3B). Average FVIII activity remained above 1% through 14 days (FIG. 3B). Pharmacokinetic parameters, measured activated partial thromboplastin time (aPTT) measurement, for rFVIIIFc-VWF-XTEN (65 IU/kg) and rFVIII (65 IU/kg) are shown in Table 10. rFVIIIFc-VWF-XTEN was observed to have an average half-life of about 42.5 hours in the human subjects, which was over 3-fold higher than the average half-life for rFVIII (about 13 hours) administered at the same dose.

TABLE 10

Pharmacokinetic (PK) Parameters for the High-Dose Cohort

| PK parameter | rFVIIIFc-VWF-XTEN Geometric Mean [Range] (N = 8) | rFVIII Geometric Mean [Range] (N = 9) | Mean Ratio [95% CI] |
|---|---|---|---|
| Half-life (h) | 42.54 [39.72-45.56] | 13.15 [10.89-15.87] | 3.24 [2.76, 3.79] $P < 0.001$ |
| $C_{max}$ (IU/dL) | 161 [142-183] | 138 [117-162] | 1.17 [1.09-1.25] $P < 0.001$ |

TABLE 10-continued

Pharmacokinetic (PK) Parameters for the High-Dose Cohort

| PK parameter | rFVIIIFc-VWF-XTEN Geometric Mean [Range] (N = 8) | rFVIII Geometric Mean [Range] (N = 9) | Mean Ratio [95% CI] |
|---|---|---|---|
| $AUC_{0-inf}$ (h × IU/dL) | 12,800 [11,100-14,900] | 1960 [1670-2310] | 6.54 [5.89-7.27] P < 0.001 |
| MRT(h) | 67.66 [62.59-73.14] | 15.66 [14.06-17.45] | 4.32 [3.96-4.72] P < 0.001 |
| CL (mL/h/kg) | 0.51 [0.44-0.59] | 3.31 [2.81-3.88] | 0.15 [0.14-0.17 P < 0.001 |
| IR (IU/dL per IU/kg) | 2.48 [2.18-2.82] | 2.11 [1.79-2.49] | 1.18 [1.10-1.26] P < 0.001 |

Conclusions:

rFVIIIFc-VWF-XTEN was well tolerated in all patients with severe hemophilia A who were treated with either a single low dose (25 IU/kg) or a single high dose (65 IU/kg). No patient developed an inhibitor to FVIII. rFVIIIFc-VWF-XTEN demonstrated a half-life that was 3-fold to 4-fold higher than rFVIII, suggesting a breakthrough in the VWF-imposed half-life ceiling. Sustained, high FVIII activity has the potential to provide extended protection against all bleed types.

Example 2: Repeat Dose Study of FVIII-XTEN-Fc/D'D3-XTEN-Fc Heterodimers rFVIIIFc-VWF-XTEN was well-tolerated and provided sustained FVIII levels in a cohort of subjects who received a single dose of rFVIIIFc-VWF-XTEN. (Example 1). The present study will evaluate the safety and tolerability and characterize the pharmacokinetics of repeat doses of rFVIIIFc-VWF-XTEN (FIG. 1).

Study Design

A total of 4 once-weekly doses of rFVIIIFc-VWF-XTEN will be administered to adult male patients with severe hemophilia A who have been previously treated with FVIII treatment and received at least 150 exposure days of such FVIII treatment. Two cohorts, each consisting of approximately ten adult males 18 to 65 years of age will be enrolled. Each subject in Cohort 1 will receive a total of four once-weekly doses of 50 IU/kg rFVIIIFc-VWF-XTEN on Days 1, 8, 15, and 22. Each subject in Cohort 2 will receive a total of four once-weekly doses of 65 IU/kg rFVIIIFc-VWF-XTEN on Days 1, 8, 15, and 22.

A schematic representation of the design of the clinical study is depicted as FIG. 4. A pre-dose pharmacokinetic sample will be taken on Day 1. In addition, there will be multiple PK samples taken after dosing on Days 1 and 22, and a trough (168h) sample occurring prior to dosing on Days 8, 15, and 22. Subjects will undergo a safety observation period for 28 days after the last dose of rFVIIIFc-VWF-XTEN, including inhibitor assessments at 14 and 28 days after the last dose of rFVIIIFc-VWF-XTEN. For subjects who complete all four once-weekly doses of rFVIIIFc-VWF-XTEN, the safety observation period will end with the end-of-study (EOS) visit at Day 50 (+3 days). For subjects who discontinue treatment early, the safety observation period will end with the early termination (ET) visit 28 days after the last dose of rFVIIIFc-VWF-XTEN.

The primary objective of the study is to assess the safety and tolerability of a total of four once-weekly doses of intravenous (IV) rFVIIIFc-VWF-XTEN. The primary endpoints are the occurrence of adverse events (AEs) and the occurrence of clinically significant abnormalities in laboratory tests, including development of inhibitors (neutralizing antibodies directed against FVIII) as determined via the Nijmegen-modified Bethesda assay. (Verbruggen et al, Thrombosis and Haemostasis, 73: 247-251 (1995)).

The secondary objective of the study is the characterization of the pharmacokinetics of rFVIIIFc-VWF-XTEN after a total of four once-weekly IV doses, with FVIII activity determined by the one-stage activated partial thromboplastin time (aPTT) clotting assay, as described in Example 1. The secondary endpoints are pharmacokinetics assessed via the estimation of parameters, including but not limited to maximum activity (Cmax), half-life (t½), total clearance at steady state (CLss), accumulating index (AI), area under the activity-time curve from hour 0 over the dosing interval (AUC0-tau), volume of distribution at steady state (Vss), mean residence time (MRT), IR, lowest (trough) concentration that a drug reaches before the next dose is administered (Ctrough), and time to 1% above baseline for FVIII activity.

The exploratory objective of the study is to characterize the pharmacokinetics of rFVIIIFc-VWF-XTEN after a total of four once-weekly IV doses, with FVIII activity determined by the two-stage chromogenic coagulation assay. The exploratory endpoints are PK assessed via the estimation of parameters, including but not limited to the Cmax, t½, CLss, AI, AUC0-tau, Vss, MRT, IR, Ctrough, and time to 1% above baseline for FVIII activity.

Methods

FVIII activity was determined by the modified activated partial thromboplastin time (aPTT) clotting assay ("one stage" assay), as detailed above in Example 1.

The two-stage chromogenic coagulation assay measures FVIII activity using the BIOPHEN FVIII:C assay (Hyphen Biomed 221402-RUO) on the BCS® XP analyzer (Siemens Healthcare Diagnostics). Briefly, phospholipids, calcium and thrombin activated FVIII:C form an enzymatic complex in the presence of a constant amount of Factor IXa. This enzymatic complex in turn activates Factor X (FX), which is supplied at a constant concentration and in excess to Factor Xa (FXa). The activation of FX to FXa is directly related to the amount of FVIII:C, which is the limiting factor in the assay in the presence of a constant and in an excess amount of Factor IXa. The activity of the generated FXa is then measured using a specific chromogenic FXa substrate, SXa-11 (Hyphen Biomed). Factor Xa cleaves SXa-11 and releases paranitroaniline (pNA). The amount of pNA released is directly proportional to the amount of FXa generated. There is a direct relationship between the amount of FVIII:C in the sample, the amount of FXa generated, and the amount of pNA released. The release of pNA is determined by color development at a wavelength of 405 nm.

8-point calibration curves (High: 1.500-0.150 IU/mL; Low: 0.200-0.008 IU/mL) are prepared using a rFVIIIFc-VWF-XTEN specific calibrator. For the high calibration curve, rFVIIIFc-VWF-XTEN at 1 IU/mL is diluted in Tris/BSA buffer to generate pre-selected calibration levels of FVIII activity. This dilution is carried out by the BCS® XP analyzer. The pre-selected calibration levels of FVIII activity are tested at a 1:4 working dilution in Tris/BSA buffer. For the low calibration curve, rFVIIIFc-VWF-XTEN at 1

IU/mL is pre-diluted 1:4 in congenital FVIII deficient plasma (Helena Laboratories) and then further diluted by the BCS® XP analyzer in Tris/BSA buffer to generate preselected calibration levels of FVIII activity which are tested in the absence of further dilution in the reaction setup.

Calibration is performed in duplicate. Curves are plotted for FVIII activity in IU/mL (x-axis) and change in absorbance/min (y-axis). For the high calibration curve, a linear log-log regression curve fit is used. For the low calibration curve, a linear lin-lin regression curve fit is used. Samples are tested in duplicate on either the high calibration curve at a 1:4 working dilution or the low calibration curve using the 1:4 dilution in congenital FVIII deficient plasma or neat (in the absence of a working dilution).

Results

Demographics and Baseline Characteristics 10 adult male subjects 18 to 65 years of age (inclusive) enrolled in Cohort 1 (50 IU/kg) and 5 adult male subjects 18 to 65 years of age (inclusive) enrolled in Cohort 2 (65 IU/kg). All 10 subjects in the 50 IU/kg dosing cohort received 4 doses of rFVIIIFc-VWF-XTEN. Three of the 5 subjects enrolled in the 65 IU/kg dosing cohort received at least one dose of rFVIIIFc-VWF-XTEN. All 15 subjects enrolled were from a single site in Sofia, Bulgaria. Of the 15 subjects enrolled, 13 subjects received at least one dose of BIVV001 and were included in the summary of demographic and baseline characteristics. All subjects were male. The median age was 35 years (range: 25 to 55 years) and all subjects were white. The median weight was 86.7 kg (range: 51.0 to 130.9 kg) and the median body mass index was 25.9 kg/m$^2$ (range: 16.4 to 40.9 kg/m$^2$).

Safety Analysis

For the interim analysis a total of 13 subjects were included in the Safety Analysis Set (n=10 from the 50 IU/kg cohort and n=3 from the 65 IU/kg cohort). All safety analyses were performed based on the Safety Analysis Set and included all subjects who received at least one dose of rFVIIIFc-VWF-XTEN A treatment-emergent AE (TEAE) is defined as any adverse event that began on or after the first rFVIIIFc-VWF-XTEN administration and within 28 days after the final rFVIIIFc-VWF-XTEN administration. AEs with missing start dates are assumed to be treatment-emergent, unless the stop date was before the dosing date. In general, AEs were summarized by subject incidence by cohort and overall as well as presented in a data listing by cohort and subject. Treatment-emergent serious adverse events (TESAEs) were also also evaluated for each subject, but none were observed in treated subjects (Table 11).

Of the 15 subjects enrolled, 13 subjects received at least one dose of rFVIIIFc-VWF-XTEN and were included in the safety analysis. 19 TEAEs were reported in 8 of the 13 subjects (61.5%) (Table 11). There were no serious or related TEAEs reported and no subject discontinued the study due to a TEAE. The most common TEAEs were arthralgia, upper respiratory tract infection, headache, and rhinitis (2/13 subjects each; 15.4%). No inhibitor development to FVIII was detected and there were no reports of serious hypersensitivity or anaphylaxis. At each level of subject summarization, a subject is counted once if the subject reported one or more events. Percentages reported in Table 11 are based on the number of subjects who received at least one dose of rFVIIIFc-VWF-XTEN in each cohort and overall.

TABLE 11

Summary of Treatment Emergent Adverse Events (TEAEs) in Safety Analysis Set

| | rFVIIIFc-VWF-XTEN 50 IU/kg | rFVIIIFc-VWF-XTEN 65 IU/kg | Major Surgical Period (N = 0) | rFVIIIFc-VWF-XTEN Total treated |
|---|---|---|---|---|
| Number of Subjects treated with rFVIIIFc-VWF-XTEN | 10 | 3 | 0 | 13 |
| Total number of TEAEs | 17 | 2 | 0 | 19 |
| Subjects with at least one TEAE | 7 (70.0%) | 1 (33.3%) | 0 | 8 (61.5%) |
| Subjects with at least one related TEAE | 0 | 0 | 0 | 0 |
| Subjects who discontinued study due to TEAE | 0 | 0 | 0 | 0 |
| Total Number of TESAEs | 0 | 0 | 0 | 0 |
| Subjects with at least one TESAE | 0 | 0 | 0 | 0 |
| Subjects with at least one related TESAE | 0 | 0 | 0 | 0 |

Immunogenicity Analysis

All subjects were assessed for inhibitor development and anti-rFVIIIFc-VWF-XTEN antibodies at Screening, Day 1, Day 8, Day 15, Day 22, Day 36, and Day 50 (EOS or ET visit). Testing for inhibitors was performed by the central laboratory using the Nijmegen-modified Bethesda assay. If a Nijmegen-modified Bethesda assay result returned as ≤0.6 BU/mL, a separate sample was collected and tested for confirmation of inhibitor development within 2 to 4 weeks. Testing for potential antibody formation was performed at a central laboratory using a validated rFVIIIFc-VWF-XTEN-specific anti-drug antibody (ADA) assay. Confirmed positive samples were further characterized for antibodies specific to FVIII, D'D3, or XTEN. The number and percentage of subjects who tested positive for inhibitor development and the number and percentage of subjects who tested positive for anti-rFVIIIFc-VWF-XTEN antibodies were summarized by cohort using the Safety Analysis Set.

No subject developed a positive anti-drug antibody assay result following rFVIIIFc-VWF-XTEN administration.

Pharmacokinetic Analysis and Results

In general, safety and PK data were summarized using standard summary statistics for continuous and categorical data. Data was summarized by cohort. Continuous variables were summarized using descriptive statistics including the number of non-missing values (n), mean, standard deviation (SD), median, minimum, and maximum. Pharmacokinetic parameters were also summarized using geometric mean and percent coefficient of variation (% CV). Categorical variables were summarized by counts and percentages.

All PK analyses were performed based on the PK analysis set (PKAS) and included 9 subjects from the 50 IU/kg dosing cohort who had adequate blood sample collections following rFVIIIFc-VWF-XTEN administration.

FVIII Activity

To characterize the pharmacokinetics of rFVIIIFc-VWF-XTEN after a total of four once-weekly IV doses, FVIII activity was determined in each subject at the prespecified time points. FVIII activity was summarized by cohort, scheduled PK visit, and timepoint for both the one-stage (activated partial thromboplastin time [aPTT]) clotting assay and the chromogenic coagulation assay. FVIII activity versus time profiles were plotted in both original and log scale for both FVIII activity assays. Individual FVIII activity was listed for each subject by cohort, scheduled PK visit and timepoint for both FVIII activity assays. Results for FVIII activity according to the one-stage [aPTT] assay are depicted in Table 12. Results for FVIII activity according to the chromogenic assay are depicted in Table 13.

Briefly, following Day 1 dosing, mean FVIII activities based on one-stage and chromogenic assay at 72 h were 45.53% and 29.37%, at 120 h were 21.56% and 13.49%, and at 168 h were 7.91% and 5.97%, respectively. Following Day 22 dosing, mean FVIII activities based on one stage and chromogenic assay at 72 h were 46.28% and 30.46%, at 120 h were 22.30% and 14.48%, and at 168 h were 9.83% and 6.74%, respectively. Generally across all patients, time points, and with both assays, the Ctrough for rFVIIIFc-VWF-XTEN at 50 IU/kg QW in this interim analysis ranged between 7-10%.

PK Parameters

Individual PK parameter estimates were listed for each subject and summarized descriptively by cohort, scheduled PK visit, and time point for both FVIII activity assays.

The geometric mean elimination half-life ($t_{1/2}$) for all subjects receiving rFVIIIFc-VWF-XTEN at 50 IU/kg QW in this interim analysis was 41.24 hours according to the one stage assay (Table 16B) and 43.87 hours according to the chromogenic assay (Table 17B).

Following Day 1 dosing, the geometric mean maximum FVIII activity ($C_{max}$) was 113 IU/dL with the one stage assay (Table 14) and 108 IU/dL with the chromogenic assay (Table 15). Following Day 22 dosing, the geometric mean FVIII activity at steady state ($C_{maxss}$) was 127 IU/dL according to the one stage assay (Table 16A) and 115 IU/dL according to the chromogenic assay (Table 17A).

Following Day 1 dosing, the geometric mean cumulative FVIII activity ($AUC_{0-tau}$) was 7650 hr*IU/dL according to the one stage assay (Table 14) and 5630 hr*IU/dL according to the chromogenic assay (Table 15). Following Day 22 dosing, the geometric mean $AUC0_{-tau}$ was 8270 hr*IU/dL according to the one stage assay (Table 16A) and 5880 hr*IU/dL according to the chromogenic assay (Table 17A).

$C_{max}$ and $AUC_{0-tau}$ data on Day 1 and Day 22 dosing indicated minimal accumulation supported by accumulation index (AI) of 1.07 (one-stage assay, Table 16B) and 1.08 (chromogenic assay, Table 17B). For all of the PK parameter data presented in Tables 12-17, values below the limit of quantification (BLQ) were treated as 0 for the purpose of analysis. Where necessary for calculation of PK parameters, as infusion end time was not captured, infusion duration was imputed as 8 minutes for each subject in line with administration guidance in the study's Directions for Handling and Administration document.

TABLE 12

Summary of Baseline-Corrected FVIII Activity Levels (IU/dL) based on one-stage aPTT clotting assay: PK Analysis Set (Dose Level: 50 IU/kg)

| Dosing Day | Timepoint | n | Mean (SD) | Median | Geo. Mean | % CV | Min, Max |
|---|---|---|---|---|---|---|---|
| Day 1 | Pre-injection | 9 | 0.00 (0.000) | 0.00 | 0.00 | — | 0.0, 0.0 |
| | 30 mins from SOI | 9 | 113.17 (20.214) | 118.10 | 111.51 | 17.862 | 82.0, 140.2 |
| | 3 hrs from SOI | 9 | 109.07 (19.243) | 109.90 | 107.49 | 17.643 | 77.4, 135.5 |
| | 24 hrs from SOI | 9 | 91.04 (15.231) | 92.80 | 89.88 | 16.730 | 68.9, 115.8 |
| | 48 hrs from SOI | 9 | 66.38 (12.231) | 65.90 | 65.30 | 18.426 | 46.7, 80.3 |
| | 72 hrs from SOI | 9 | 45.53 (6.742) | 45.60 | 45.08 | 14.807 | 36.7, 53.9 |
| | 120 hrs from SOI | 9 | 21.56 (4.473) | 22.20 | 21.11 | 20.750 | 14.2, 27.1 |
| Day 8 | Pre injection | 9 | 7.91 (2.869) | 7.40 | 7.48 | 36.265 | 4.0, 13.1 |
| Day 15 | Pre injection | 9 | 8.94 (3.322) | 7.80 | 8.34 | 37.140 | 3.9, 13.5 |
| Day 22 | Pre injection | 9 | 9.91 (2.838) | 11.61 | 9.49 | 28.633 | 5.0, 12.9 |
| | 30 mins from SOI | 9 | 132.77 (31.741) | 131.80 | 129.56 | 23.907 | 96.0, 190.7 |
| | 3 hrs from SOI | 9 | 120.94 (22.168) | 126.60 | 119.03 | 18.329 | 85.2, 152.0 |
| | 24 hrs from SOI | 9 | 103.79 (18.513) | 110.20 | 102.21 | 17.838 | 74.0, 126.3 |
| | 48 hrs from SOI | 9 | 69.89 (12.812) | 68.10 | 68.84 | 18.332 | 49.8, 91.7 |
| | 72 hrs from SOI | 9 | 46.28 (7.720) | 47.90 | 45.68 | 16.682 | 33.4, 58.3 |
| | 120 hrs from SOI | 9 | 22.30 (4.979) | 21.70 | 21.77 | 22.329 | 13.7, 29.8 |
| | 168 hrs from SOI | 9 | 9.83 (3.847) | 9.60 | 9.16 | 39.120 | 4.9, 15.5 |
| | 240 hrs from SOI | 9 | 2.84 (0.999) | 2.80 | 2.68 | 35.117 | 1.4, 4.4 |
| | 336 hrs from SOI | 9 | 1.28 (2.651) | 0.00 | 0.00 | 207.494 | 0.0, 8.2 |

Abbreviations:
SD = standard deviation,
Geo. Mean = geometric mean,
% CV = percent coefficient of variation,
Min = minimum value,
Max = maximum value,
SOI = start of injection

TABLE 13

Summary of Baseline-Corrected FVIII Activity Levels (IU/dL) based on chromogenic assay: PK Analysis Set (Dose Level: 50 IU/kg)

| Dosing Day | Timepoint | n | Mean (SD) | Median | Geo. Mean | % CV | Min, Max |
|---|---|---|---|---|---|---|---|
| Day 1 | Pre-injection | 9 | 0.00 (0.000) | 0.00 | 0.00 | — | 0.0, 0.0 |
| | 30 mins from SOI | 9 | 108.94 (15.126) | 113.00 | 107.99 | 13.884 | 87.4, 129.9 |
| | 3 hrs from SOI | 9 | 101.86 (13.782) | 102.50 | 100.99 | 13.531 | 79.1, 118.3 |
| | 24 hrs from SOI | 9 | 71.68 (14.654) | 73.50 | 70.24 | 20.445 | 47.8, 93.5 |

TABLE 13-continued

Summary of Baseline-Corrected FVIII Activity Levels (IU/dL) based on chromogenic assay: PK Analysis Set (Dose Level: 50 IU/kg)

| Dosing Day | Timepoint | n | Mean (SD) | Median | Geo. Mean | % CV | Min, Max |
|---|---|---|---|---|---|---|---|
| | 48 hrs from SOI | 9 | 43.84 (7.086) | 43.40 | 43.32 | 16.163 | 32.5, 54.0 |
| | 72 hrs from SOI | 9 | 29.37 (5.319) | 30.10 | 28.93 | 18.112 | 22.3, 37.2 |
| | 120 hrs from SOI | 9 | 13.49 (2.680) | 13.80 | 13.24 | 19.870 | 9.4, 17.2 |
| Day 8 | Pre injection | 9 | 5.97 (1.764) | 6.20 | 5.74 | 29.568 | 3.6, 9.4 |
| Day 15 | Pre injection | 9 | 6.93 (1.736) | 6.70 | 6.74 | 25.044 | 4.8, 10.0 |
| Day 22 | Pre injection | 9 | 7.13 (1.817) | 7.50 | 6.93 | 25.466 | 5.0, 10.4 |
| | 30 mins from SOI | 9 | 113.58 (14.920) | 113.25 | 112.72 | 13.137 | 91.3, 137.6 |
| | 3 hrs from SOI | 9 | 109.08 (16.394) | 112.50 | 107.96 | 15.029 | 85.4, 132.6 |
| | 24 hrs from SOI | 9 | 72.13 (14.985) | 71.40 | 70.78 | 20.774 | 56.6, 95.8 |
| | 48 hrs from SOI | 9 | 45.23 (4.907) | 46.10 | 44.99 | 10.847 | 37.4, 52.3 |
| | 72 hrs from SOI | 9 | 30.46 (5.247) | 31.20 | 30.04 | 17.230 | 21.4, 39.6 |
| | 120 hrs from SOI | 9 | 14.48 (2.862) | 13.70 | 14.23 | 19.769 | 10.5, 18.7 |
| | 168 hrs from SOI | 9 | 6.74 (1.911) | 6.20 | 6.51 | 28.328 | 4.4, 9.7 |
| | 240 hrs from SOI | 9 | 2.20 (1.025) | 2.20 | 0.00 | 46.577 | 0.0, 3.7 |
| | 336 hrs from SOI | 9 | 0.46 (1.021) | 0.00 | 0.00 | 224.158 | 0.0, 3.0 |

Abbreviations:
SD = standard deviation,
Geo. Mean = geometric mean,
% CV = percent coefficient of variation,
Min = minimum value,
Max = maximum value,
SOI = start of injection

TABLE 14

Day 1 Dosing Summary of Pharmacokinetic Parameters for Baseline-Corrected FVIII Activity based on one-stage aPTT clotting assay: PK Analysis Set

| Subject No. | Actual Dose (IU/kg) | CMAX (IU/dL) | TMAX (hr) | AUC0-tau (hr * IU/dL) | Dose-normalized AUC0-tau (hr * kg * IU/dL/IU) | IVR (%) | IR (IU/dL per IU/kg) |
|---|---|---|---|---|---|---|---|
| Cohort 1 (50 IU/kg): BIVV001 Day 1 Dosing | | | | | | | |
| 170-001 | 50.0 | 91.7 | 3.13 | 7940 | 159 | 52.5 | 1.83 |
| 170-002 | 49.9 | 140 | 0.50 | 8310 | 166 | 97.4 | 2.81 |
| 170-003 | 50.2 | 82.0 | 0.50 | 6000 | 119 | 53.1 | 1.63 |
| 170-004 | 50.1 | 131 | 3.00 | 9300 | 186 | 95.9 | 2.61 |
| 170-006 | 50.0 | 139 | 0.50 | 7960 | 159 | 89.4 | 2.78 |
| 170-007 | 49.8 | 109 | 0.50 | 7480 | 150 | 71.1 | 2.19 |
| 170-009 | 50.0 | 121 | 2.85 | 8170 | 163 | 85 | 2.42 |
| 170-010 | 50.2 | 99.1 | 0.50 | 5750 | 115 | 61.3 | 1.97 |
| 170-011 | 49.8 | 118 | 0.50 | 8740 | 176 | 64.2 | 2.37 |
| n | 9 | 9 | 9 | 9 | 9 | 9 | 9 |
| Mean | 50.00 | 115 | 1.33 | 7740 | 155 | 74.4 | 2.29 |
| Median | 50.00 | 118 | 0.5 | 7960 | 159 | 71.1 | 2.37 |
| Std. Dev | 0.150 | 20.7 | 1.25 | 1180 | 23.8 | 17.9 | 0.42 |
| % CV | 0 | 18 | 94 | 15 | 15 | 24 | 18 |
| Geo. Mean | 50.00 | 113 | 0.91 | 7650 | 153 | 72.5 | 2.26 |
| (95% CI) | (49.88, 50.12) | (97.6, 130) | (0.46, 1.81) | (6750, 8670) | (135, 174) | (60.1, 87.5) | (1.95, 2.61) |
| Minimum | 49.8 | 82.0 | 0.50 | 5750 | 115 | 52.5 | 1.63 |
| Maximum | 50.2 | 140 | 3.13 | 9300 | 186 | 97.4 | 2.81 |

Abbreviations:
Std Dev = standard deviation,
Geo. Mean = geometric mean,
% CV = percent coefficient of variation,
CMAX = maximum concentration at steady state,
TMAX = time to reach maximum concentration,
CMAXSS = maximum concentration at steady state,
IVR = in vivo recovery,
AUC0-inf = area under the activity-time curve from time 0 to infinity,
AUC0-tau = area under the activity-time curve from hour 0 over the dosing interval,
MRTINF = mean residence time extrapolated to infinity,
AI = accumulating index,
IR = incremental recovery,
Ctrough = lowest concentration that a drug reaches before the next dose is administered,
Cavg = average concentration after reaching steady state,
$t^{1/2}$ = elimination half-life,
CLss = clearance at steady state,
Vss = volume of distribution at steady state.

TABLE 15

Day 1 Summary of Pharmacokinetic Parameters for Baseline-Corrected FVIII Activity based on chromogenic assay: PK Analysis Set

| Subject No. | Actual Dose (IU/kg) | CMAX (IU/dL) | TMAX (hr) | AUC0-tau (hr * IU/dL) | Dose-normalized AUC0-tau (hr * kg * IU/dL/IU) | IVR (%) | IR (IU/dL per IU/kg) |
|---|---|---|---|---|---|---|---|
| Cohort 1 (50 IU/kg): BIVV001 Day 1 Dosing | | | | | | | |
| 170-001 | 50 | 90.8 | 0.63 | 5850 | 117 | 52 | 1.82 |
| 170-002 | 49.9 | 130 | 0.5 | 6160 | 123 | 90.2 | 2.6 |
| 170-003 | 50.2 | 87.4 | 0.5 | 4290 | 85.4 | 56.6 | 1.74 |
| 170-004 | 50.1 | 124 | 0.5 | 7030 | 140 | 90.5 | 2.47 |
| 170-006 | 50 | 117 | 0.5 | 5530 | 111 | 74.9 | 2.33 |
| 170-007 | 49.8 | 105 | 0.5 | 5580 | 112 | 68.3 | 2.1 |
| 170-009 | 50 | 119 | 0.5 | 6500 | 130 | 84 | 2.39 |
| 170-010 | 50.2 | 95.4 | 0.5 | 4360 | 86.9 | 59 | 1.9 |
| 170-011 | 49.8 | 113 | 0.5 | 5970 | 120 | 61.4 | 2.27 |
| n | 9 | 9 | 9 | 9 | 9 | 9 | 9 |
| Mean | 50 | 109 | 0.51 | 5700 | 114 | 70.8 | 2.18 |
| Median | 50 | 113 | 0.5 | 5850 | 117 | 68.3 | 2.27 |
| Std. Dev | 0.15 | 15.1 | 0.04 | 905 | 18.2 | 14.8 | 0.3 |
| % CV | 0 | 14 | 9 | 16 | 16 | 21 | 14 |
| Geo. Mean | 50 | 108 | 0.51 | 5630 | 113 | 69.4 | 2.16 |
| (95% CI) | (49.88, 50.12) | (96.8, 120) | (0.48, 0.55) | (4950, 6400) | (98.9, 128) | (59.1, 81.5) | (1.93, 2.41) |
| Minimum | 49.8 | 87.4 | 0.5 | 4290 | 85.4 | 52 | 1.74 |
| Maximum | 50.2 | 130 | 0.63 | 7030 | 140 | 90.5 | 2.6 |

Abbreviations:
Std Dev = standard deviation,
Geo. Mean = geometric mean,
% CV = percent coefficient of variation,
CMAX = maximum concentration at steady state,
TMAX = time to reach maximum concentration,
CMAXSS = maximum concentration at steady state,
IVR = in vivo recovery,
AUC0-inf = area under the activity-time curve from time 0 to infinity,
AUC0-tau = area under the activity-time curve from hour 0 over the dosing interval,
MRTINF = mean residence time extrapolated to infinity,
AI = accumulating index,
IR = incremental recovery,
Ctrough = lowest concentration that a drug reaches before the next dose is administered,
Cavg = average concentration after reaching steady state,
$t_{1/2}$ = elimination half-life,
CLss = clearance at steady state,
Vss = volume of distribution at steady state.

TABLE 16A

Day 22 - Summary of Pharmacokinetic Parameters for Baseline-Corrected FVIII Activity based on one-stage aPTT clotting assay: PK Analysis Set (Part 1)
Activity based on chromogenic assay: PK Analysis Set

| Subject No. | Actual Dose (IU/kg) | CMAX SS (IU/dL) | AUC0-inf (hr * IU/dL) | Dose-normalized AUC0-inf (hr * kg * IU/dL/IU) | AUC0-tau (hr * IU/dL) | Dose-normalized AUC0-tau (hr * kg * IU/dL/IU) |
|---|---|---|---|---|---|---|
| Cohort 1 (50 IU/kg): BIVV001 Day 22 Dosing | | | | | | |
| 170-001 | 50.1 | 106 | 9230 | 184 | 8240 | 165 |
| 170-002 | 49.9 | 135 | 8690 | 174 | 8310 | 167 |
| 170-003 | 50 | 104 | 7520 | 150 | 6950 | 139 |
| 170-004 | 50 | 143 | 11000 | 219 | 10100 | 201 |
| 170-006 | 50 | 165 | 9480 | 190 | 9210 | 184 |
| 170-007 | 49.9 | 132 | 9300 | 186 | 8550 | 171 |
| 170-009 | 49.8 | 154 | 8980 | 180 | 8580 | 172 |
| 170-010 | 49.8 | 96 | 6130 | 123 | 5810 | 117 |
| 170-011 | 49.9 | 129 | 10200 | 205 | 9560 | 192 |
| n | 99 | 9 | 9 | 9 | 9 | 9 |
| Mean | 49.93 | 129 | 8940 | 179 | 8370 | 168 |

TABLE 16A-continued

Day 22 - Summary of Pharmacokinetic Parameters for Baseline-Corrected FVIII
Activity based on one-stage aPTT clotting assay: PK Analysis Set (Part 1)
Activity based on chromogenic assay: PK Analysis Set

| Subject No. | Actual Dose (IU/kg) | CMAX SS (IU/dL) | AUC0-inf (hr * IU/dL) | Dose-normalized AUC0-inf (hr * kg * IU/dL/IU) | AUC0-tau (hr * IU/dL) | Dose-normalized AUC0-tau (hr * kg * IU/dL/IU) |
|---|---|---|---|---|---|---|
| Median | 49.9 | 132 | 9230 | 184 | 8550 | 171 |
| Std. Dev | 0.1 | 23.2 | 1420 | 28.4 | 1310 | 26.1 |
| % CV | 0 | 18 | 16 | 16 | 16 | 16 |
| Geo. Mean | 49.93 | 127 | 8830 | 177 | 8270 | 166 |
| (95% CI) | (49.86, 50.01) | (110, 147) | (7740, 10100) | (155, 202) | (7260, 9410) | (145, 188) |
| Minimum | 49.8 | 96 | 6130 | 123 | 5810 | 117 |
| Maximum | 50.1 | 165 | 11000 | 219 | 10100 | 201 |

Abbreviations:

Std Dev = standard deviation,

Geo. Mean = geometric mean,

% CV = percent coefficient of variation,

CMAX = maximum concentration at steady state,

TMAX = time to reach maximum concentration,

CMAXSS = maximum concentration at steady state,

IVR = in vivo recovery,

AUC0-inf = area under the activity-time curve from time 0 to infinity,

AUC0-tau = area under the activity-time curve from hour 0 over the dosing interval, MRTINF = mean residence time extrapolated to infinity, AI = accumulating index, IR = incremental recovery, Ctrough = lowest concentration that a drug reaches before the next dose is administered, Cavg = average concentration after reaching steady state, t½ = elimination half-life, CLss = clearance at steady state, Vss = volume of distribution at steady state.

TABLE 16B

Day 22 - Summary of Pharmacokinetic Parameters for Baseline-Corrected FVIII
Activity based on one-stage aPTT clotting assay: PK Analysis Set (Part 2)

| Subject No. | t½ (hr) | MRTINF (hr) | CLss (mL/hr/kg) | Vss (mL/kg) | AI | Ctrough (IU/dL) | Cavg (IU/dL) |
|---|---|---|---|---|---|---|---|
| Cohort 1 (50 IU/kg): BIVV001 Day 22 Dosing | | | | | | | |
| 170-001 | 50.05 | 78.56 | 0.61 | 47.8 | 1.11 | 15.2 | 49.1 |
| 170-002 | 36.86 | 57.13 | 0.6 | 34.3 | 1.04 | 7 | 49.5 |
| 170-003 | 43.86 | 66.35 | 0.72 | 47.8 | 1.08 | 9.6 | 41.4 |
| 170-004 | 45.45 | 69.54 | 0.5 | 34.5 | 1.08 | 15.5 | 60 |
| 170-006 | 34.21 | 49.79 | 0.54 | 27 | 1.03 | 4.9 | 54.8 |
| 170-007 | 48.87 | 67.08 | 0.58 | 39.1 | 1.1 | 11.5 | 50.9 |
| 170-009 | 34.63 | 56.19 | 0.58 | 32.6 | 1.04 | 7.8 | 51.1 |
| 170-010 | 38.29 | 58.71 | 0.86 | 50.3 | 1.05 | 5.8 | 34.6 |
| 170-011 | 42.34 | 63.41 | 0.52 | 33.1 | 1.07 | 11.2 | 56.9 |
| n | 9 | 9 | 9 | 9 | 9 | 9 | 9 |
| Mean | 41.62 | 62.97 | 0.61 | 38.5 | 1.07 | 9.83 | 49.8 |
| Median | 42.34 | 63.41 | 0.58 | 34.5 | 1.07 | 9.6 | 50.9 |
| Std. Dev | 5.93 | 8.57 | 0.11 | 8.21 | 0.03 | 3.85 | 7.79 |
| % CV | 14 | 14 | 18 | 21 | 3 | 39 | 16 |
| Geo. Mean | 41.24 | 62.46 | 0.6 | 37.7 | 1.07 | 9.16 | 49.2 |

TABLE 16B-continued

Day 22 - Summary of Pharmacokinetic Parameters for Baseline-Corrected FVIII
Activity based on one-stage aPTT clotting assay: PK Analysis Set (Part 2)

| Subject No. | $t_{1/2}$ (hr) | MRTINF (hr) | CLss (mL/hr/kg) | Vss (mL/kg) | AI | Ctrough (IU/dL) | Cavg (IU/dL) |
|---|---|---|---|---|---|---|---|
| (95% CI) | (36.95, 46.04) | (56.27, 69.33) | (0.531, 0.688) | (32.0, 44.4) | (1.05, 1.09) | (6.70, 12.5) | (43.2, 56.0) |
| Minimum | 34.21 | 49.79 | 0.5 | 27 | 1.03 | 4.9 | 34.6 |
| Maximum | 50.05 | 78.56 | 0.86 | 50.3 | 1.11 | 15.5 | 60 |

Abbreviations:
Std Dev = standard deviation,
Geo. Mean = geometric mean,
% CV = percent coefficient of variation,
CMAX = maximum concentration at steady state,
TMAX = time to reach maximum concentration,
CMAXSS = maximum concentration at steady state,
IVR = in vivo recovery,
AUC0-inf = area under the activity-time curve from time 0 to infinity,
AUC0-tau = area under the activity-time curve from hour 0 over the dosing interval,
MRTINF = mean residence time extrapolated to infinity,
AI = accumulating index,
IR = incremental recovery,
Ctrough = lowest concentration that a drug reaches before the next dose is administered,
Cavg = average concentration after reaching steady state,
$t_{1/2}$ = elimination half-life,
CLss = clearance at steady state,
Vss = volume of distribution at steady state.

TABLE 17A

Day 22 - Summary of Pharmacokinetic Parameters for Baseline-Corrected
FVIII Activity based on chromogenic assay: PK Analysis Set (Part 1)

| Subject No. | Actual Dose (IU/kg) | CMAX SS (IU/dL) | AUC0-inf (hr * IU/dL) | Dose-normalized AUC0-inf (hr * kg * IU/dL/IU) | AUC0-tau (hr * IU/dL) | Dose-normalized AUC0-tau (hr * kg * IU/dL/IU) |
|---|---|---|---|---|---|---|
| Cohort 1 (50 IU/kg): BIVV001 Day 22 Dosing | | | | | | |
| 170-001 | 50.1 | 103 | 6560 | 131 | 5810 | 116 |
| 170-002 | 49.9 | 124 | 6830 | 137 | 6430 | 129 |
| 170-003 | 50.0 | 91.3 | 5210 | 104 | 4780 | 95.5 |
| 170-004 | 50.0 | 126 | 7050 | 141 | 6410 | 128 |
| 170-006 | 50.0 | 138 | 6520 | 130 | 6300 | 126 |
| 170-007 | 49.9 | 117 | 6460 | 129 | 5990 | 120 |
| 170-009 | 49.8 | 123 | 6620 | 133 | 6290 | 126 |
| 170-010 | 49.8 | 103 | 5080 | 102 | 4800 | 96.5 |
| 170-011 | 49.9 | 113 | 6910 | 138 | 6450 | 129 |
| n | 9 | 9 | 9 | 9 | 9 | 9 |
| Mean | 49.93 | 115 | 6360 | 127 | 5920 | 119 |
| Median | 49.9 | 117 | 6560 | 131 | 6290 | 126 |
| Std. Dev | 0.100 | 14.5 | 718 | 14.3 | 674 | 13.5 |
| % CV | 0 | 13 | 11 | 11 | 11 | 11 |
| Geo. Mean | 49.93 | 115 | 6320 | 127 | 5880 | 118 |
| (95% CI) | (49.86, 50.01) | (104, 126) | (5760, 6940) | (115, 139) | (5360, 6460) | (107, 129) |
| Minimum | 49.8 | 91.3 | 5080 | 102 | 4780 | 95.5 |

Abbreviations:
Std Dev = standard deviation,
Geo. Mean = geometric mean,
% CV = percent coefficient of variation,
CMAX = maximum concentration at steady state,
TMAX = time to reach maximum concentration,
CMAXSS = maximum concentration at steady state,
IVR = in vivo recovery,
AUC0-inf = area under the activity-time curve from time 0 to infinity,
AUC0-tau = area under the activity-time curve from hour 0 over the dosing interval,
MRTINF = mean residence time extrapolated to infinity,
AI = accumulating index,
IR = incremental recovery,
Ctrough = lowest concentration that a drug reaches before the next dose is administered,
Cavg = average concentration after reaching steady state,
$t_{1/2}$ = elimination half-life,
CLss = clearance at steady state,
Vss = volume of distribution at steady state.

TABLE 17B

Day 22 - Summary of Pharmacokinetic Parameters for Baseline-Corrected FVIII
Activity based on chromogenic assay: PK Analysis Set (Part 2)

| Subject No. | t½ (hr) | MRTINF (hr) | CLss (mL/hr/kg) | Vss (mL/kg) | AI | Ctrough (IU/dL) | Cavg (IU/dL) |
|---|---|---|---|---|---|---|---|
| Cohort 1 (50 IU/kg): BIVV001 Day 22 Dosing | | | | | | | |
| 170-001 | 53.31 | 76.94 | 0.86 | 66.3 | 1.13 | 9.6 | 34.6 |
| 170-002 | 44.73 | 55.57 | 0.78 | 43.1 | 1.08 | 6 | 38.3 |
| 170-003 | 48.29 | 64.39 | 1.05 | 67.4 | 1.1 | 6.2 | 28.4 |
| 170-004 | 46.03 | 71.12 | 0.78 | 55.5 | 1.09 | 9.7 | 38.2 |
| 170-006 | 35.59 | 47.89 | 0.79 | 38 | 1.04 | 4.4 | 37.5 |
| 170-007 | 45.35 | 62.51 | 0.83 | 52 | 1.08 | 7 | 35.7 |
| 170-009 | 40.09 | 54.93 | 0.79 | 43.5 | 1.06 | 5.5 | 37.4 |
| 170-010 | 40.2 | 56.26 | 1.04 | 58.3 | 1.06 | 4.8 | 28.6 |
| 170-011 | 43.61 | 60.71 | 0.77 | 47 | 1.07 | 7.5 | 38.4 |
| n | 9 | 9 | 9 | 9 | 9 | 9 | 9 |
| Mean | 44.13 | 61.15 | 0.85 | 52.4 | 1.08 | 6.74 | 35.2 |
| Median | 44.73 | 60.71 | 0.79 | 52 | 1.08 | 6.2 | 37.4 |
| Std. Dev | 5.15 | 8.88 | 0.11 | 10.4 | 0.03 | 1.91 | 4.01 |
| % CV | 12 | 15 | 13 | 20 | 2 | 28 | 11 |
| Geo. Mean | 43.87 | 60.59 | 0.85 | 51.4 | 1.08 | 6.51 | 35 |
| (95% CI) | (40.08, 48.01) | (54.25, 67.67) | (0.773, 0.932) | (44.1, 60.0) | (1.06, 1.10) | (5.26, 8.07) | (31.9, 38.4) |
| Minimum | 35.59 | 47.89 | 0.77 | 38 | 1.04 | 4.4 | 28.4 |
| Maximum | 53.31 | 76.94 | 1.05 | 67.4 | 1.13 | 9.7 | 38.4 |

Abbreviations:
Std Dev = standard deviation,
Geo. Mean = geometric mean,
% CV = percent coefficient of variation, CMAX = maximum concentration at steady state,
TMAX = time to reach maximum concentration,
CMAXSS = maximum concentration at steady state,
IVR = in vivo recovery,
AUC0-inf = area under the activity-time curve from time 0 to infinity,
AUC0-tau = area under the activity-time curve from hour 0 over the dosing interval,
MRTINF = mean residence time extrapolated to infinity,
AI = accumulating index,
IR = incremental recovery,
Ctrough = lowest concentration that a drug reaches before the next dose is administered,
Cavg = average concentration after reaching steady state,
t½ = elimination half-life,
CLss = clearance at steady state,
Vss = volume of distribution at steady state.

Conclusions

Consistent with the results observed in the single dose study (Example 1), the weekly dosing of rFVIIIFc-VWF-XTEN was generally well tolerated and no inhibitors were detected through 28 days following the final rFVIIIFc-VWF-XTEN administration. rFVIIIFc-VWF-XTEN at a dose of 50 IU/kg exhibited mean elimination half-life ($t_{1/2}$) of 41.24 and 43.87 hours with the one stage and chromogenic assays, respectively. These interim results demonstrate that the enhanced half-life observed in single dosing of rFVIIIFc-VWF-XTEN is maintained with repeat dosing QW, strongly signaling that the advantages of rFVIIIFc-VWF-XTEN can be realized by hemophilia A patients receiving treatment according to a prophylactic FVIII dosing schedule.

Example 3: Phase 3 Study of rFVIIIFc-VWF-XTEN in Previously Treated Patients with Severe Hemophilia A The present study will evaluate the safety and tolerability and characterize the pharmacokinetics of once weekly administration of 50 IU/kg rFVIIIFc-VWF-XTEN (FIG. 1). The primary objective of the study is to evaluate the efficacy of rFVIIIFc-VWF-XTEN prophylactic treatment compared with rFVIIIFc-VWF-XTEN on-demand treatment. The secondary objection of the study is to evaluate rFVIIIFc-VWF-XTEN as a prophylactic treatment, its effect on bleeding episodes and consumption of rFVIIIFc-VWF-XTEN, joint health, and quality of life as measured by Patient-Reported Outcomes (PROs), and evaluate rFVIIIFc-VWF-XTEN for on-demand treatment.

In addition, the pharmacokinetic (PK) objective is to characterize the PK of rFVIIIFc-VWF-XTEN prophylaxis at baseline for all subjects and repeated at three months for a predefined subset of subjects, based on the aPTT FVIII activity assay. Additional objectives are to evaluate the efficacy of rFVIIIFc-VWF-XTEN in subjects who undergo surgery, and to evaluate the safety and tolerability of rFVIIIFc-VWF-XTEN. Further, joint health structural outcomes will be assessed via ultrasound, and the impact of treatment on other quality of life measurements and on healthcare resource utilization will be assessed.

Study Design

This is a pivotal, Phase 3, open-label, multicenter study of the safety, efficacy and PK of intravenous rFVIIIFc-VWF-XTEN in patients years of age with severe hemophilia A (defined as <1 IU/dL [<1%] endogenous FVIII). Approximately twenty-five subjects currently on an on-demand regimen will receive rFVIIIFc-VWF-XTEN at a dose of 50 IU/kg IV on an on-demand basis for twenty-six weeks, then receive rFVIIIFc-VWF-XTEN at a dose of 50 IU/kg IV once-weekly on a prophylactic treatment regimen for twenty-six weeks. Subjects currently on a prophylactic treatment regimen will receive rFVIIIFc-VWF-XTEN at a dose of 50 IU/kg IV once-weekly on a prophylactic treatment regimen for fifty-two weeks.

Approximately 140 subjects years of age will be enrolled; repeat PK assessments will be performed on a subset of approximately sixteen subjects at 12 weeks.

Subjects will be screened and, after meeting enrollment criteria, proceed to one of two treatment regimens (i.e., on demand or prophylaxis) with rFVIIIFc-VWF-XTEN at a dose of 50 IU/kg IV. All subjects will undergo baseline PK assessments after a washout period (at least 4 to 5 days, depending on current therapy). Subjects will undergo efficacy and safety assessments throughout the study. These safety assessments will include testing for potential inhibitor formation. A follow-up safety visit or telephone call will occur twenty-eight days after the last dose of rFVIIIFc-VWF-XTEN, unless the subject enrolls in the open-label extension study.

End of study (EOS) may occur when both criteria have been met: (i) at least 104 subjects have reached 50 exposure days (EDs) and have completed a valid inhibitor test after the 50th ED; and (ii) at least twenty-five subjects have completed the on-demand arm of the study, including the 26-week prophylactic treatment period, or withdrawn from the study early. In addition, subjects from any arm who undergo surgery during the study will be included in the surgery subset. A minimum of ten major surgeries in at least five subjects will be targeted to assess control and prevention of bleeding in the surgical setting.

Subjects will come to the clinic within an approximately 28-day Screening Period for determination of eligibility. In addition to the Screening Visit(s), subjects will return to the clinic for visits at Baseline, Week 4, Week 12, Week 26, Week 36, Week 52, and EOS/ET. The Dosing Period will be over 52 weeks. Subjects who enter on the prophylactic treatment arm will receive 52 once-weekly doses of rFVIIIFc-VWF-XTEN and additional doses as necessary to treat bleeding episodes. Subjects who enter on the on-demand treatment arm will receive rFVIIIFc-VWF-XTEN on-demand during the 26-week on-demand treatment period and 26 once-weekly doses of rFVIIIFc-VWF-XTEN and additional doses as necessary to treat bleeding episodes during the subsequent 26-week prophylactic treatment period. Safety will be assessed throughout the study. A Follow-Up Safety Visit or Telephone Call will occur 28 days after the last dose of rFVIIIFc-VWF-XTEN, unless the subject enrolls in the open-label extension study.

The primary endpoint of the study will be an intra-subject comparison of the Annualized Bleeding Rate (ABR) while subjects are on rFVIIIFc-VWF-XTEN on-demand treatment (26 weeks) versus once-weekly prophylactic treatment (26 weeks).

The secondary endpoints of the study will include (i) an intra-subject comparison of ABR on rFVIIIFc-VWF-XTEN prophylaxis versus the historical ABR (for subjects on prophylaxis who participated in a previous observational study); (ii) the occurrence of bleeding episodes and consumption (overall ABR, ABR by type and location, and total, annualized rFVIIIFc-VWF-XTEN consumption per subject); (iii) the response to treatment; (iv) efficacy index (percentage of subjects that maintain trough level of L3% at day 7; (v) joint health; and (vi) changes in quality of life measures (haem-A-QoL and PROM IS-SF physical Function for subjects at least 18 years old; and HAEMO-QoL and PROMIS Pediatric-SF Physical Activity for subjects less than 18 years old.

The response to treatment will include the (i) number of infusions and dose of rFVIIIFc-VWF-XTEN required to resolve a bleeding episode; (ii) percentage of bleeding episodes that require a single infusion for resolution; (iii) subject's assessment of response to rFVIIIFc-VWF-XTEN treatment of individual bleeding episodes based on a 4-point response scale; (iv) and investigator's global assessment of subject's response to rFVIIIFc-VWF-XTEN treatment based on a 4-point response scale.

Joint health evaluation will include (i) ABR of joint bleeding episodes; (ii) Target joint resolution at 52 weeks, based on the International Society on Thrombosis and Haemostasis (ISTH) criteria; (iii) Functional outcomes based on absolute change from baseline to 52 weeks assessed by the modified Hemophilia Joint Health Score (mHJHS) or HJHS); (iv) Percentage of subjects with no joint deterioration at 52 weeks assessed by the mHJHS or HJHS.

Additional endpoints include (i) Maximum (peak) plasma drug concentration (Cmax), elimination half-life (t½), accumulation index (AI), area under the plasma concentration-time curve (AUC), apparent volume of distribution at steady state (Vss), mean residence time (MRT), incremental recovery (IR), trough plasma concentration (Ctrough), and time above predefined FVIII activity levels; (ii) Investigators' or Surgeons' assessments of subjects' hemostatic response to rFVIIIFc-VWF-XTEN treatment on a 4-point response scale, number and dose of infusions required to maintain hemostasis during the surgery, total rFVIIIFc-VWF-XTEN consumption during the surgical period, estimated blood loss during surgery, number and type of blood component transfusions required during surgery, and bleeding episodes post-surgery during the surgical period; (iii) the occurrence of adverse events (AEs) and serious adverse events (SAEs), clinically significant abnormalities in physical examination, vital signs, and laboratory tests, and the development of inhibitors (neutralizing antibodies directed against FVIII as determined via the Nijmegen-modified Bethesda assay; and (iv) anatomical structural joint health outcomes via ultrasound imaging in a subpopulation, changes in other QoL measures (EQ-5D-5L, PGIC (week 52 only), PROMIS Pain Intensity, PROMIS-SF Pain Interference (subjects ≤18 years old), PROMIS Pediatric-SF Pain Interference (subjects <18 years old)), and HRU.

Inclusion/Exclusion Criteria

Eligible candidates must meet the following eligibility criteria: (1) years of age at the time of informed consent; (2) severe hemophilia A, defined as ≤1 IU/dL (<1%) endogenous FVIII as documented by a certified clinical laboratory; (3) previous treatment for hemophilia A (prophylactic or on demand) with any recombinant and/or plasma-derived FVIII, or cryoprecipitate for at least 150 EDs; (4) currently on a prophylactic treatment regimen with a marketed FVIII product and had at least four bleeding episodes in the twelve months prior to study enrollment, or currently on an on-demand treatment regimen with a marketed FVIII product and had at least twelve bleeding episodes in the twelve months prior to study enrollment; and (5) platelet count ≤100,000 cells/µL at screening (test performed by the central laboratory and reviewed prior to the Day 1 dose). Subjects will be excluded for any of the following reasons: (1) other known coagulation disorder(s) in addition to hemophilia A; (2) history of hypersensitivity or anaphylaxis associated with any FVIII product; (3) history of a positive inhibitor test or clinical signs of decreased response to FVIII administrations (family history of inhibitors will not exclude the subject); (4) positive inhibitor result, taken at screening, defined as 0.6 BU/mL; (5) abnormal renal function, defined as serum creatinine >2.0 mg/dL taken at Screening; (6) serum alanine aminotransferase (ALT) or aspartate aminotransferase (AST) >5×upper limit of normal (ULN) taken at Screening; (7) serum total bilirubin >3×ULN, taken at Screening; (8) fitusiran or emicizumab use within the 12 weeks prior to Screening; (9) treatment within 12 weeks prior to screening with a monoclonal antibody therapeutic, an Fc fusion protein other than rFVIIIFc, or IV immunoglobulin; (10) Treatment with acetylsalicylic acid (ASA) within 2 weeks prior to screening or treatment with non-steroidal anti-inflammatory drugs (NSAIDs) at or above the maximum dose specified in the regional prescribing information for each product; (11) systemic treatment within 12 weeks prior to screening with chemotherapy and/or other immunosuppressive drugs (except for the treatment of hepatitis C virus [HCV] or HIV; use of corticosteroids is allowed, except for systemic corticosteroid treatment given daily or on alternate days at 20 mg/day of prednisone or its equivalent for >14 days; local, topical, and/or inhaled steroid use is permitted; and (12) major surgery within 8 weeks prior to screening (major surgery is defined as any surgical procedure (elective or emergent) that usually, but not always, involves general anesthesia and/or respiratory assistance, in which a major body cavity is penetrated and exposed, or a substantial impairment of physical or physiological functions is produced (e.g., laparotomy, thoracotomy, craniotomy, joint replacement, or limb amputation)).

Sequences

```
VWF031 nucleotide Sequence
                                                         (SEQ ID NO: 147)
   1 ATGAT TCCTG CCAGA TTTGC CGGGG TGCTG CTTGC TCTGG CCCTC ATTTT
  51 GCCAG GGACC CTTTG TGCAG AAGGA ACTCG CGGCA GGTCA TCCAC GGCCC
 101 GATGC AGCCT TTTCG GAAGT GACTT CGTCA ACACC TTTGA TGGGA GCATG
 151 TACAG CTTTG CGGGA TACTG CAGTT ACCTC CTGGC AGGGG CTGCA CAGAA
 201 ACGCT CCTTC TCGAT TATTG GGAC TTCCA GAATG CAAG AGAGT GAGCC
 251 TCTCC GTGTA TCTTG GGAA TTTTT TGACA TCCAT TTGTT TGTCA ATGGT
 301 ACCGT GACAC AGGGG GACCA AAGAG TCTCC ATGCC CTATG CCTCC AAAGG
 351 GCTGT ATCTA GAAAC TGAGG CTGGG TACTA CAAGC TGTCC GGTGA GGCCT
 401 ATGGC TTTGT GGCCA GGATC GATGG CAGCG GCAAC TTTCA AGTCC TGCTG
 451 TCAGA CAGAT ACTTC AACAA GACCT GCGGG CTGTG TGGCA ACTTT AACAT
 501 CTTTG CTGAA GATGA CTTTA TGACC CAAGA AGGGA CCTTG ACCTC GGACC
 551 CTTAT GACTT TGCCA ACTCA TGGGC TCTGA GCAGT GGAGA ACAGT GGTGT
 601 GAACG GCAT CTCCT CCCAG CAGCT CATGC AACAT CTCCT CTGGG GAAAT
 651 GCAGA AGGGC CTGTG GGAGC AGTGC CAGCT TCTGA AGAGC ACCTC GGTGT
 701 TTGCC CGCTG CCACC CTCTG GTGGA CCCCG AGCCT TTTGT GGCCC TGTGT
 751 GAGAA GACTT TGTGT GAGTG TGCTG GGGG CTGGA GTGCG CCTGC CCTGC
 801 CCTCC TGGAG TACGC CCGGA CCTGT GCCCA GGAGG AATG GTGCT GTACG
 851 GCTGG ACCGA CCACA GCGCG TGCAG CCCAG TGTGC CCTGC TGGTA TGGAG
 901 TATAG GCAGT GTGTG TCCCC TTGCG CCAGG ACCTG CCAGA GCCTG CACAT
 951 CAATG AAATG TGTCA GGAGC GATGC GTGGA TGGCT GCAGC TGCCC TGAGG
1001 GACAG CTCCT GGATG AAGGC CTCTG CGTGG AGAGC ACCGA GTGTC CCTGC
1051 GTGCA TTCCG GAAAG CGCTA CCCTC CCGGC ACCTC CCTCT CTCGA GACTG
1101 CAACA CCTGC ATTTG CCGAA ACAGC CAGTG GATCT GCAGC AATGA AGAAT
1151 GTCCA GGGGA GTGCC TTGTC ACTGG TCAAT CCCAC TTCAA GAGCT TTGAC
1201 AACAG ATACT TCACC TTCAG TGGGA TCTGC CAGTA CCTGC TGGCC CGGGA
1251 TTGCC AGGAC CACTC CTTCT CCATT GTCAT TGAGA CTGTC CAGTG TGCTG
1301 ATGAC CGCGA CGCTG TGTGC ACCCG CTCCG TCACC GTCCG GCTGC CTGGC
1351 CTGCA CAACA GCCTT GTGAA ACTGA AGCAT GGGGC AGGAG TTGCC ATGGA
1401 TGGCC AGGAC ATCCA GCTCC CCCTC CTGAA AGGTG ACCTC CGCAT CCAGC
1451 ATACA GTGAC GGCCT CCGTG CGCCT CAGCT ACGGG GAGGA CCTGC AGATG
1501 GACTG GGATG GCCGC GGGAG GCTGC TGGTG AAGCT GTCCC CCGTC TATGC
```

-continued

```
1551 CGGGA AGACC TGCGG CCTGT GTGGG AATTA CAATG GCAAC CAGGG CGACG

1601 ACTTC CTTAC CCCCT CTGGG CTGGC GGAGC CCCGG GTGGA GGACT TCGGG

1651 AACGC CTGGA AGCTG CACGG GGACT GCCAG GACCT GCAGA AGCAG CACAG

1701 CGATC CCTGC GCCCT CAACC CGCGC ATGAC CAGGT TCTCC GAGGA GGCGT

1751 GCGCG GTCCT GACGT CCCCC ACATT CGAGG CCTGC CATCG TGCCG TCAGC

1801 CCGCT GCCCT ACCTG CGGAA CTGCC GCTAC GACGT GTGCT CCTGC TCGGA

1851 CGGCC GCGAG TGCCT GTGCG GCGCC CTGGC CAGCT ATGCC GCGGC CTGCG

1901 CGGGG AGAGG CGTGC GCGTC GCGTG GCGCG AGCCA GGCCG CTGTG AGCTG

1951 AACTG CCCGA AAGGC CAGGT GTACC TGCAG TGCGG ACCCC CTGC AACCT

2001 GACCT GCCGC TCTCT CTCTT ACCCG GATGA GGAAT GCAAT GAGGC CTGCC

2051 TGGAG GGCTG CTTCT GCCCC CCAGG GCTCT ACATG GATGA GAGGG GGGAC

2101 TGCGT GCCCA AGGCC CAGTG CCCCT GTTAC ATGGA CGGTG AGATC TTCCA

2151 GCCAG AAGAC ATCTT CTCAG ACCAT CACAC CATGT GCTAC TGTGA GGATG

2201 GCTTC ATGCA CTGTA CCATG AGTGG AGTCC CCGGA AGCTT GCTGC CTGAC

2251 GCTGT CCTCA GCAGT CCCCT GTCTC ATCGC AGCAA AAGGA GCCTA TCCTG

2301 TCGGC CCCCC ATGGT CAAGC TGGTG TGTCC CGCTG ACAAC TGCGG GGCTG

2351 AAGGG CTCGA GTGTA CCAAA ACGTG CCAGA ACTAT GACCT GGAGT GCATG

2401 AGCAT GGGCT GTGTC TCTGG CTGCC TCTGC CCCCC GGGCA TGGTC CGGCA

2451 TGAGA ACAGA TGTGT GGCCC TGGAA AGGTG TCCCT GCTTC CATCA GGGCA

2501 AGGAG TATGC CCCTG GAGAA ACAGT GAAGA TTGGC TGCAA CACTT GTGTC

2551 TGTCG GGACC GGAAG TGGAA CTGCA CAGAC CATGT GTGTG ATGCC ACGTG

2601 CTCCA CGATC GGCAT GGCCC ACTAC CTCAC CTTCG ACGGG CTCAA ATACC

2651 TGTTC CCCGG GGAGT GCCAG TACGT TCTGG TGCAG GATTA CTGCG GCAGT

2701 AACCC TGGGA CCTTT CGGAT CCTAG TGGGG AATAA GGGAT GCAGC CACCC

2751 CTCAG TGAAA TGCAA GAAAC GGGTC ACCAT CCTGG TGGAG GGAGG AGAGA

2801 TTGAG CTGTT TGACG GGGAG GTGAA TGTGA AGAGG CCCAT GAAGG ATGAG

2851 ACTCA CTTTG AGGTG GTGGA GTCTG GCCGG TACAT CATTC TGCTG CTGGG

2901 CAAAG CCCTC TCCGT GGTCT GGGAC CGCCA CCTGA GCATC TCCGT GGTCC

2951 TGAAG CAGAC ATACC AGGAG AAAGT GTGTG GCCTG TGTGG AATTT TTGAT

3001 GGCAT CCAGA ACAAT GACCT CACCA GCAGC AACCT CCAAG TGGAG GAAGA

3051 CCCTG TGGAC TTTGG GAACT CCTGG AAAGT GAGCT CGCAG TGTGC TGACA

3101 CCAGA AAAGT GCCTC TGGAC TCATC CCCTG CCACC TGCCA TAACA ACATC

3151 ATGAA GCAGA CGATG GTGGA TTCCT CCTGT AGAAT CCTTA CCAGT GACGT

3201 CTTCC AGGAC TGCAA CAAGC TGGTG GACCC CGAGC CATAT CTGGA TGTCT

3251 GCATT TACGA CACCT GCTCC TGTGA GTCCA TTGGG GACTG CGCCG CATTC

3301 TGCGA CACCA TTGCT GCCTA TGCCC ACGTG TGTGC CCAGC ATGGC AAGGT

3351 GGTGA CCTGG AGGAC GGCCA CATTG TGCCC CCAGA CTGCC GAGGA GAGGA

3401 ATCTC CGGGA GAACG GGTAT GAGGC TGAGT GGCGC TATAA CAGCT GTGCA

3451 CCTGC CTGTC AAGTC ACGTG TCAGC ACCCT GAGCC ACTGG CCTGC CCTGT

3501 GCAGT GTGTG GAGGG CTGCC ATGCC CACTG CCCTC CAGGG AAAAT CCTGG
```

```
3551 ATGAG CTTTT GCAGA CCTGC GTTGA CCCTG AAGAC TGTCC AGTGT GTGAG
3601 GTGGC TGGCC GGCGT TTTGC CTCAG GAAAG AAAGT CACCT TGAAT CCCAG
3651 TGACC CTGAG CACTG CCAGA TTTGC CACTG TGATG TTGTC AACCT CACCT
3701 GTGAA GCCTG CCAGG AGCCG ATATC TGGCG GTGGA GGTTC CGGTG CGGG
3751 GGATC CGGCG GTGGA GGTTC CGGCG GTGGA GGTTC CGGTG CGGGG GATC
3801 CGGTG CGGGG GATCC CTGG TCCCC CGGGG CAGCG GCGGT GGAGG TTCCG
3851 GTGGC GGGGG ATCCG ACAAA ACTCA CACAT GCCCA CCGTG CCCAG CTCCA
3901 GAACT CCTGG GCGGA CCGTC AGTCT CCTC TTCCC CCCAA AACCC AAGGA
3951 CACCC TCATG ATCTC CCGGA CCCCT GAGGT CACAT GCGTG GTGGT GGACG
4001 TGAGC CACGA AGACC CTGAG GTCAA GTTCA ACTGG TACGT GGACG GCGTG
4051 GAGGT GCATA ATGCC AAGAC AAAGC CGCGG GAGGA GCAGT ACAAC AGCAC
4101 GTACC GTGTG GTCAG CGTCC TCACC GTCCT GCACC AGGAC TGGCT GAATG
4151 GCAAG GAGTA CAAGT GCAAG GTCTC CAACA AAGCC CTCCC AGCCC CCATC
4201 GAGAA AACCA TCTCC AAAGC CAAAG GGCAG CCCCG AGAAC CACAG GTGTA
4251 CACCC TGCCC CCATC CCGCG ATGAG CTGAC CAAGA ACCAG GTCAG CCTGA
4301 CCTGC CTGGT CAAAG GCTTC TATCC CAGCG ACATC GCCGT GGAGT GGGAG
4351 AGCAA TGGGC AGCCG GAGAA CAACT ACAAG ACCAC GCCTC CCGTG TTGGA
4401 CTCCG ACGGC TCCTT CTTCC TCTAC AGCAA GCTCA CCGTG GACAA GAGCA
4451 GGTGG CAGCA GGGGA ACGTC TTCTC ATGCT CCGTG ATGCA TGAGG CTCTG
4501 CACAA CCACT ACACG CAGAA GAGCC TCTCC CTGTC TCCGG GTAAA TGA
```

VWF031 protein Sequence (SEQ ID NO: 86)

```
  1 MIPARFAGVL LALALILPGT LCAEGTRGRS STARCSLFGS DFVNTFDGSM
 51 YSFAGYCSYL LAGGCQKRSF SIIGDFQNGK RVSLSVYLGE FFDIHLFVNG
101 TVTQGDQRVS MPYASKGLYL EIEAGYYKLS GEAYGFVARI DGSGNFQVLL
151 SDRYFNKTCG LCGNFNIFAE DDFMTQEGTL TSDPYDFANS WALSSGEQWC
201 ERASPPSSSC NISSGEMQKG LWEQCQLLKS TSVFARCHPL VDPEPFVALC
251 EKTLCECAGG LECACPALLE YARTCAQEGM VLYGWTDHSA CSPVCPAGME
301 YRQCVSPCAR TCQSLHINEM CQERCVDGCS CPEGQLLDEG LCVESTECPC
351 VHSGKRYPPG TSLSRDCNTC ICRNSQWICS NEECPGECLV TGQSHFKSFD
401 NRYFTFSGIC QYLLARDCQD HSFSIVIETV QCADDRDAVC TRSVTVRLPG
451 LHNSLVKLKH GAGVAMDGQD IQLPLLKGDL RIQHTVTASV RLSYGEDLQM
501 DWDGRGRLLV KLSPVYAGKT CGLCGNYNGN QGDDFLTPSG LAEPRVEDFG
551 NAWKLHGDCQ DLQKQHSDPC ALNPRMTRFS EEACAVLTSP TFEACHRAVS
601 PLPYLRNCRY DVCSCSDGRE CLCGALASYA AACAGRGVRV AWREPGRCEL
651 NCPKGQVYLQ CGTPCNLTCR SLSYPDEECN EACLEGCFCP PGLYMDERGD
701 CVPKAQCPCY YDGEIFQPED IFSDHHTMCY CEDGFMHCTM SGVPGSLLPD
751 AVLSSPLSHR SKRSLSCRPP MVKLVCPADN LRAEGLECTK TCQNYDLECM
801 SMGCVSGCLC PPGMVRHENR CVALERCPCF HQGKEYAPGE TVKIGCNTCV
851 CRDRKWNCTD HVCDATCSTI GMAHYLTFDG LKYLFPGECQ YVLVQDYCGS
```

```
 901 NPGTFRILVG NKGCSHPSVK CKKRVTILVE GGEIELFDGE VNVKRPMKDE
 951 THFEVVESGR YIILLLGKAL SVVWDRHLSI SVVLKQTYQE KVCGLCGNFD
1001 GIQNNDLTSS NLQVEEDPVD FGNSWKVSSQ CADTRKVPLD SSPATCHNNI
1051 MKQTMVDSSC RILTSDVFQD CNKLVDPEPY LDVCIYDTCS CESIGDCAAF
1101 CDTIAAYAHV CAQHGKVVTW RTATLCPQSC EERNLRENGY EAEWRYNSCA
1151 PACQVTCQHP EPLACPVQCV EGCHAHCPPG KILDELLQTC VDPEDCPVCE
1201 VAGRRFASGK KVTLNPSDPE HCQICHCDVV NLTCEACQEP ISGGGGSGGG
1251 GSGGGGSGGG GSGGGGSGGG GSLVPRGSGG GGSGGGGSDK THTCPPCPAP
1301 ELLGGPSVFL FPPKPKDTLM ISRTPEVTCV VVDVSHEDPE VKFNWYVDGV
1351 EVHNAKTKPR EEQYNSTYRV VSVLTVLHQD WLNGKEYKCK VSNKALPAPI
1401 EKTISKAKGQ PREPQVYTLP PSRDELTKNQ VSLTCLVKGF YPSDIAVEWE
1451 SNGQPENNYK TTPPVLDSDG SFFLYSKLTV DKSRWQQGNV FSCSVMHEAL
1501 HNHYTQKSLS LSPGK*
```

VWF034 nucleotide Sequence (SEQ ID NO: 148)
```
   1 ATGAT TCCTG CCAGA TTTGC CGGGG TGCTG CTTGC TCTGG CCCTC ATTTT
  51 GCCAG GGACC CTTTG TGCAG AAGGA ACTCG CGGCA GGTCA TCCAC GGCCC
 101 GATGC AGCCT TTTCG GAAGT GACTT CGTCA CACCT TTGA TGGGA GCATG
 151 TACAG CTTTG CGGGA TACTG CAGTT ACCTC CTGGC AGGGG GCTGC AGAAC
 201 ACGCT CCTTC TCGAT TATTG GGGAC TTCCA GAATG CAAGA GAGT GAGCC
 251 TCTCC GTGTA TCTTG GGAAT TTTT TGACA TCCAT TTGTT TGTCA ATGGT
 301 ACCGT GACAC AGGGG ACCA AAGAG TCTCC ATGCC CTATG CCTCC AAAGG
 351 GCTGT ATCTA GAAAC TGAGG CTGGG TACTA CAAGC TGTCC GGTGA GGCCT
 401 ATGGC TTTGT GGCCA GGATC GATGG CAGCG GCAAC TTTCA GTCCT GCTGG
 451 TCAGA CAGAT ACTTC AACAA GACCT GCGGG CTGTG TGGCA ACTTT AACAT
 501 CTTTG CTGAA GATGA CTTTA TGACC CAAGA AGGGA CCTTG ACCTC GGACC
 551 CTTAT GACTT TGCCA ACTCA TGGGC TCTGA GCAGT GGAGA CAGT GGTGT
 601 GAACG GGCAT CTCCT CCCAG CAGCT CATGC AACAT CTCCT CTGGG AAAT
 651 GCAGA AGGGC TGTGT GGAGC AGTGC AGCT TCTGA AGAGC ACCTC GGTGT
 701 TTGCC CGCTG CCACC CTCTG GTGGA CCCCG AGCCT TTTGT GGCCC TGTGT
 751 GAGAA GACTT TGTGT GAGTG TGCTG GGGGG CTGGA GTGCG CCTGC CCTGC
 801 CCTCC TGGAG TACGC CCGGA CCTGT GCCCA GGAGG AATG GTGCT GTACG
 851 GCTGG ACCGA CCACA GCGCG TGCAG CCCAG TGTGC CCTGC TGGTA TGGAG
 901 TATAG GCAGT GTGTG TCCCC TTGCG CCAGG ACCTG CCAGA GCCTG CACAT
 951 CAATG AAATG TGTCA GGAGC GATGC GTGGA TGGCT GCAGC TGCCC TGAGG
1001 GACAG CTCCT GGATG AAGGC TCTG CGTGG AGAGC ACCGA GTGTC CCTGC
1051 GTGCA TTCCG GAAAG CGCTA CCCTC CCGGC ACCTC CCTCT CTCGA GACTG
1101 CAACA CCTGC ATTTG CCGAA ACAGC CAGTG GATCT GCAGC AATGA AGAAT
1151 GTCCA GGGGA GTGCC TTGTC ACTGG TCAAT CCCAC TTCAA GAGCT TTGAC
1201 AACAG ATACT TCACC TTCAG TGGGA TCTGC CAGTA CCTGC TGGCC CGGGA
1251 TTGCC AGGAC CACTC CTTCT CCATT GTCAT TGAGA CTGTC CAGTG TGCTG
```

```
1301  ATGAC CGCGA CGCTG TGTGC ACCCG CTCCG TCACC GTCCG GCTGC CTGGC
1351  CTGCA CAACA GCCTT GTGAA ACTGA AGCAT GGGGC AGGAG TTGCC ATGGA
1401  TGGCC AGGAC ATCCA GCTCC CCCTC CTGAA AGGTG ACCTC CGCAT CCAGC
1451  ATACA GTGAC GGCCT CCGTG CGCCT CAGCT ACGGG AGGA CCTGC AGATG
1501  GACTG GGATG GCCGC GGGAG CTGC TGGTG AAGCT GTCCC CCGTC TATGC
1551  CGGGA AGACC TGCGG CCTGT GTGGG AATTA CAATG GCAAC CAGGG CGACG
1601  ACTTC CTTAC CCCCT CTGGG CTGGC GGAGC CCCGG GTGGA GGACT TCGGG
1651  AACGC CTGGA AGCTG CACGG GGACT GCCAG GACCT GCAGA AGCAG CACAG
1701  CGATC CCTGC GCCCT CAACC GCGCG ATGAC CAGGT TCTCC GAGGA GGCGT
1751  GCGCG GTCCT GACGT CCCCC ACATT CGAGG CCTGC CATCG TGCCG TCAGC
1801  CCGCT GCCCT ACCTG CGGAA CTGCC GCTAC GACGT GTGCT CCTGC TCGGA
1851  CGGCC GCGAG TGCCT GTGCG GCGCC CTGGC CAGCT ATGCC GCGGC CTGCG
1901  CGGGG AGAGG CGTGC GCGTC GCGTG GCGCG AGCCA GGCCG CTGTG AGCTG
1951  AACTG CCCGA AAGGC CAGGT GTACC TGCAG TGCGG ACCCC CCTGC AACCT
2001  GACCT GCCGC TCTCT CTCTT ACCCG GATGA GGAAT GCAAT GAGGC CTGCC
2051  TGGAG GGCTG CTTCT GCCCC CAGG GCTCT ACATG GATGA GAGGG GGGAC
2101  TGCGT GCCCA AGGCC CAGTG CCCCT GTTAC TATGA CGGTG AGATC TTCCA
2151  GCCAG AAGAC ATCTT CTCAG ACCAT CACAC CATGT GCTAC TGTGA GGATG
2201  GCTTC ATGCA CTGTA CCATG AGTGG AGTCC CCGGA AGCTT GCTGC CTGAC
2251  GCTGT CCTCA GCAGT CCCCT GTCTC ATCGC AGCAA AAGGA GCCTA CCCTG
2301  TCGGC CCCCC ATGGT CAAGC TGGTG TGTCC CGCTG ACAAC CTGCG GGCTG
2351  AAGGG CTCGA GTGTA CCAAA ACGTG CCAGA ACTAT GACCT GGAGT GCATG
2401  AGCAT GGGCT GTGTC TCTGG CTGCC TCTGC CCCCC GGGCA TGGTC CGGCA
2451  TGAGA ACAGA TGTGT GGCCC TGGAA AGGTG TCCCT GCTTC ATCA GGGCA
2501  AGGAG TATGC CCCTG GAGAA ACAGT GAAGA TTGGC TGCAA CACTT GTGTC
2551  TGTCG GGACC GGAAG TGGAA CTGCA CAGAC CATGT GTGTG ATGCC ACGTG
2601  CTCCA CGATC GGCAT GGCCC ACTAC CTCAC CTTCG ACGGG CTCAA ATACC
2651  TGTTC CCCGG GGAGT GCCAG TACGT TCTGG TGCAG GATTA CTGCG GCAGT
2701  AACCC TGGGA CCTTT CGGAT CCTAG TGGGG AATAA GGGAT GCAGC CACCC
2751  CTCAG TGAAA TGCAA GAAAC GGGTC ACCAT CCTGG TGGAG GGAGG AGAGA
2801  TTGAG CTGTT TGACG GGGAG GTGAA TGTGA AGAGG CCCAT GAAGG ATGAG
2851  ACTCA CTTTG AGGTG GTGGA GTCTG GCCGG TACAT CATTC TGCTG CTGGG
2901  CAAAG CCCTC TCCGT GGTCT GGGAC CGCCA CCTGA GCATC CCGT GGTCC
2951  TGAAG CAGAC ATACC AGGAG AAAGT GTGTG GCCTG TGTGG AATT TTGAT
3001  GGCAT CCAGA ACAAT GACCT CACCA GCAGC AACCT CCAAG TGGAG GAAGA
3051  CCCTG TGGAC TTTGG GAACT CCTGG AAAGT GAGCT CGCAG TGTGC TGACA
3101  CCAGA AAAGT GCCTC TGGAC TCATC CCCTG CCACC TGCCA TAACA ACATC
3151  ATGAA GCAGA CGATG GTGGA TTCCT CCTGT AGAAT CCTTA CCAGT GACGT
3201  CTTCC AGGAC TGCAA CAAGC TGGTG GACCC CGAGC CATAT CTGGA TGTCT
```

```
3251 GCATT TACGA CACCT GCTCC TGTGA GTCCA TTGGG GACTG CGCCG CATTC

3301 TGCGA CACCA TTGCT GCCTA TGCCC ACGTG TGTGC CCAGC ATGGC AAGGT

3351 GGTGA CCTGG AGGAC GGCCA CATTG TGCCC CCAGA GCTGC GAGGA GAGGA

3401 ATCTC CGGGA GAACG GGTAT GAGGC TGAGT GGCGC TATAA CAGCT GTGCA

3451 CCTGC CTGTC AAGTC ACGTG TCAGC ACCCT GAGCC ACTGG CCTGC CCTGT

3501 GCAGT GTGTG GAGGG CTGCC ATGCC CACTG CCCTC CAGGG AAAAT CCTGG

3551 ATGAG CTTTT GCAGA CCTGC GTTGA CCCTG AAGAC TGTCC AGTGT GTGAG

3601 GTGGC TGGCC GGCGT TTTGC CTCAG GAAAG AAAGT CACCT TGAAT CCCAG

3651 TGACC CTGAG CACTG CCAGA TTTGC CACTG TGATG TTGTC AACCT CACCT

3701 GTGAA GCCTG CCAGG AGCCG ATATC GGGTA CCTCA GAGTC TGCTA CCCCC

3751 GAGTC AGGGC CAGGA TCAGA GCCAG CCACC TCCGG GTCTG AGACA CCCGG

3801 GACTT CCGAG AGTGC ACCCC TGAGT CCGGA CCCG GTCC GAGCC CGCCA

3851 CTTCC GGCTC CGAAA CTCCC GGCAC AAGCG AGAGC GCTAC CCCAG AGTCA

3901 GGACC AGGAA CATCT ACAGA GCCCT CTGAA GGCTC CGCTC CAGGG TCCCC

3951 AGCCG GCAGT CCCAC TAGCA CCGAG GAGGG AACCT CTGAA GCGC CACAC

4001 CCGAA TCAGG GCCAG GGTCT GAGCC TGCTA CCAGC GGCAG CGAGA CACCA

4051 GGCAC CTCTG AGTCC GCCAC ACCAG AGTCC GGACC CGGAT CTCCC GCTGG

4101 GAGCC CCACC TCCAC TGAGG AGGGA CTCC TGCTG GCTCT CCAAC ATCTA

4151 CTGAG GAAGG TACCT CAACC GAGCC ATCCG AGGGA TCAGC TCCCG GCACC

4201 TCAGA GTCGG CAACC CCGGA GTCTG GACCC GGAAC TTCCG AAAGT GCCAC

4251 ACCAG AGTCC GGTCC CGGGA CTTCA GAATC AGCAA CACCC GAGTC CGGCC

4301 CTGGG TCTGA ACCCG CCACA GTGG TAGTG AGACA CCAGG ATCAG AACCT

4351 GCTAC CTCAG GGTCA GAGAC ACCCG GATCT CCGGC AGGCT CACCA ACCTC

4401 CACTG AGGAG GGCAC CAGCA CAGAA CCAAG CGAGG GCTCC GCACC CGGAA

4451 CAAGC ACTGA ACCCA GTGAG GGTTC AGCAC CCGGC TCTGA GCCGG CCACA

4501 AGTGG CAGTG AGACA CCCGG CACTT CAGAG AGTGC CACCC CGAG AGTGG

4551 CCCAG GCACT AGTAC CGAGC CCTCT GAAGG CAGTG CGCCA GATTC TGGCG

4601 GTGGA GGTTC CGGTG GCGGG GGATC CGGTG GCGGG GGATC CGGTG GCGGG

4651 GGATC CGGTG GCGGG GGATC CCTGG TCCCC CGGGG CAGCG GAGGC GACAA

4701 AACTC ACACA TGCCC ACCGT GCCCA GCTCC AGAAC TCCTG GGCGG ACCGT

4751 CAGTC TTCCT CTTCC CCCCA AAACC CAAGG ACACC CTCAT GATCT CCCGG

4801 ACCCC TGAGG TCACA TGCGT GGTGG TGGAC GTGAG CCACG AAGAC CCTGA

4851 GGTCA AGTTC AACTG GTACG TGGAC GGCGT GGAGG TGCAT AATGC CAAGA

4901 CAAAG CCGCG GGAGG AGCAG TACAA CAGCA CGTAC CGTGT GGTCA GCGTC

4951 CTCAC CGTCC TGCAC CAGGA CTGGC TGAAT GGCAA GGAGT ACAAG TGCAA

5001 GGTCT CCAAC AAAGC CCTCC CAGCC CCCAT CGAGA AAACC ATCTC CAAAG

5051 CCAAA GGGCA GCCCC GAGAA CCACA GGTGT ACACC CTGCC CCCAT CCCGG

5101 GATGA GCTGA CCAAG AACCA GGTCA GCCTG ACCTG CCTGG TCAAA GGCTT

5151 CTATC CCAGC GACAT CGCCG TGGAG TGGGA GAGCA ATGGG CAGCC GGAGA

5201 ACAAC TACAA GACCA CGCCT CCCGT GTTGG ACTCC GACGG CTCCT TCTTC
```

```
5251 CTCTA CAGCA AGCTC ACCGT GGACA AGAGC AGGTG GCAGC AGGGG AACGT

5301 CTTCT CATGC TCCGT GATGC ATGAG GCTCT GCACA CCAC TACAC GCAGA

5351 AGAGC CTCTC CCTGT CTCCG GGTAA ATGA
```

VWF034 Protein Sequence (SEQ ID NO: 87)

```
   1 MIPARFAGVL LALALILPGT LCAEGTRGRS STARCSLFGS DFVNTFDGSM

51 YSFAGYCSYL LAGGCQKRSF SIIGDFQNGK RVSLSVYLGE FFDIHLFVNG

101 TVTQGDQRVS MPYASKGLYL EIEAGYYKLS GEAYGFVARI DGSGNFQVLL

151 SDRYFNKTCG LCGNFNIFAE DDFMTQEGTL TSDPYDFANS WALSSGEQWC

201 ERASPPSSSC NISSGEMQKG LWEQCQLLKS TSVFARCHPL VDPEPFVALC

251 EKTLCECAGG LECACPALLE YARTCAQEGM VLYGWTDHSA CSPVCPAGME

301 YRQCVSPCAR TCQSLHINEM CQERCVDGCS CPEGQLLDEG LCVESTECPC

351 VHSGKRYPPG TSLSRDCNTC ICRNSQWICS NEECPGECLV TGQSHFKSFD

401 NRYFTFSGIC QYLLARDCQD HSFSIVIETV QCADDRDAVC TRSVTVRLPG

451 LHNSLVKLKH GAGVAMDGQD IQLPLLKGDL RIQHTVTASV RLSYGEDLQM

501 DWDGRGRLLV KLSPVYAGKT CGLCGNYNGN QGDDFLTPSG LAEPRVEDFG

551 NAWKLHGDCQ DLQKQHSDPC ALNPRMTRFS EEACAVLTSP TFEACHRAVS

601 PLPYLRNCRY DVCSCSDGRE CLCGALASYA AACAGRGVRV AWREPGRCEL

651 NCPKGQVYLQ CGTPCNLTCR SLSYPDEECN EACLEGCFCP PGLYMDERGD

701 CVPKAQCPCY YDGEIFQPED IFSDHHTMCY CEDGFMHCTM SGVPGSLLPD

751 AVLSSPLSHR SKRSLSCRPP MVKLVCPADN LRAEGLECTK TCQNYDLECM

801 SMGCVSGCLC PPGMVRHENR CVALERCPCF HQGKEYAPGE TVKIGCNTCV

851 CRDRKWNCTD HVCDATCSTI GMAHYLTFDG LKYLFPGECQ YVLVQDYCGS

901 NPGTFRILVG NKGCSHPSVK CKKRVTILVE GGEIELFDGE VNVKRPMKDE

951 THFEVVESGR YIILLLGKAL SVVWDRHLSI SVVLKQTYQE KVCGLCGNFD

1001 GIQNNDLTSS NLQVEEDPVD FGNSWKVSSQ CADTRKVPLD SSPATCHNNI

1051 MKQTMVDSSC RILTSDVFQD CNKLVDPEPY LDVCIYDTCS CESIGDCAAF

1101 CDTIAAYAHV CAQHGKVVTW RTATLCPQSC EERNLRENGY EAEWRYNSCA

1151 PACQVTCQHP EPLACPVQCV EGCHAHCPPG KILDELLQTC VDPEDCPVCE

1201 VAGRRFASGK KVTLNPSDPE HCQICHCDVV NLTCEACQEP ISGTSESATP

1251 ESGPGSEPAT SGSETPGTSE SATPESGPGS EPATSGSETP GTSESATPES

1301 GPGTSIEPSE GSAPGSPAGS PTSIEEGTSE SATPESGPGS EPATSGSETP

1351 GTSESATPES GPGSPAGSPT SIEEGSPAGS PTSTEEGTST EPSEGSAPGT

1401 SESATPESGP GTSESATPES GPTSESATP ESGPGSEPAT SGSETPGSEP

1451 ATSGSETPGS PAGSPTSIEE GTSIEPSEGS APGTSIEPSE GSAPGSEPAT

1501 SGSETPGTSE SATPESGPGT SIEPSEGSAP DIGGGGSGG GGSLVPRGSG

1551 GDKTHTCPPC PAPELLGGPS VFLFPPKPKD TLMISRTPEV TCVVVDVSHE

1601 DPEVKFNWYV DGVEVHNAKT KPREEQYNST YRVVSVLTVL HQDWLNGKEY

1651 KCKVSNKALP APIEKTISKA KGQPREPQVY TLPPSRDELT KNQVSLTCLV
```

1701 KGFYPSDIAV EWESNGQPEN NYKTTPPVLD SDGSFFLYSK LTVDKSRWQQ

1751 GNVFSCSVMH EALHNHYTQK SLSLSPGK*

VWF050 nucleotide sequence (IHH triple mutant)

(SEQ ID NO: 149)

```
   1 ATGAT TCCTG CCAGA TTTGC CGGGG TGCTG CTTGC TCTGG CCCTC ATTTT
  51 GCCAG GGACC CTTTG TGCAG AAGGA ACTCG CGGCA GGTCA TCCAC GGCCC
 101 GATGC AGCCT TTTCG GAAGT GACTT CGTCA ACACC TTTGA TGGGA GCATG
 151 TACAG CTTTG CGGGA TACTG CAGTT ACCTC CTGGC AGGGG CTGCA GAAA
 201 ACGCT CCTTC TCGAT TATTG GGGAC TTCCA GAATG CAAG AGAGT GAGCC
 251 TCTCC GTGTA TCTTG GGGAA TTTTT TGACA TCCAT TTGTT TGTCA ATGGT
 301 ACCGT GACAC AGGGG GACCA AAGAG TCTCC ATGCC TATG CCTCC AAAGG
 351 GCTGT ATCTA GAAAC TGAGG CTGGG TACTA CAAGC TGTCC GGTGA GGCCT
 401 ATGGC TTTGT GGCCA GGATC GATGG CAGCG GCAAC TTTCA GTCC TGCTG
 451 TCAGA CAGAT ACTTC AACAA GACCT GCGGG CTGTG TGGCA ACTTT AACAT
 501 CTTTG CTGAA GATGA CTTTA TGACC CAAGA AGGGA CCTTG ACCTC GGACC
 551 CTTAT GACTT TGCCA ACTCA TGGGC TCTGA GCAGT GGAGA ACAGT GGTGT
 601 GAACG GGCAT CTCCT CCCAG CAGCT CATGC AACAT CTCCT CTGGG AAAT
 651 GCAGA AGGGC TGTGG GGAGC AGTGC AGCT TCTGA AGAGC ACCTC GGTGT
 701 TTGCC CGCTG CCACC CTCTG GTGGA CCCCG AGCCT TTTGT GGCCC TGTGT
 751 GAGAA GACTT TGTGT GAGTG TGCTG GGGGG CTGGA GTGCG CCTGC CCTGC
 801 CCTCC TGGAG TACGC CCGGA CCTGT GCCCA GGAGG GAATG GTGCT GTACG
 851 GCTGG ACCGA CCACA GCGCG TGCAG CCCAG TGTGC CCTGC TGGTA TGGAG
 901 TATAG CAGT GTGTG TCCCC TTGCG CCAGG ACCTG CCAGA GCCTG CACAT
 951 CAATG AAATG TGTCA GGAGC GATGC GTGGA TGGCT GCAGC TGCCC TGAGG
1001 GACAG CTCCT GGATG AAGGC CTCTG CGTGG AGAGC ACCGA GTGTC CCTGC
1051 GTGCA TTCCG GAAAG CGCTA CCCTC CCGGC ACCTC CCTCT CTCGA GACTG
1101 CAACA CCTGC ATTTG CCGAA ACAGC CAGTG GATCT GCAGC AATGA AGAAT
1151 GTCCA GGGGA GTGCC TTGTC ACTGG TCAAT CCCAC TTCAA GAGCT TTGAC
1201 AACAG ATACT TCACC TTCAG TGGGA TCTGC CAGTA CCTGC TGGCC CGGGA
1251 TTGCC AGGAC CACTC CTTCT CCATT GTCAT TGAGA CTGTC CAGTG TGCTG
1301 ATGAC CGCGA CGCTG TGTGC ACCCG CTCCG TCACC GTCCG GCTGC CTGGC
1351 CTGCA CAACA GCCTT GTGAA CTGA AGCAT GGGGC AGGAG TTGCC ATGGA
1401 TGGCC AGGAC ATCCA GCTCC CCCTC CTGAA GGTG ACCTC CGCAT CCAGC
1451 ATACA GTGAC GGCCT CCGTG CGCCT CAGCT ACGGG AGGGA CCTGC AGATG
1501 GACTG GGATG GCCGC GGGAG GCTGC TGGTG AAGCT GTCCC CCGTC TATGC
1551 CGGGA AGACC TGCGG CCTGT GTGGG AATTA CAATG GCAAC CAGGG CGACG
1601 ACTTC CTTAC CCCCT CTGGG CTGGC GGAGC CCCGG GTGGA GGACT TCGGG
1651 AACGC CTGGA AGCTG CACGG GGACT GCCAG GACCT GCAGA AGCAG CACAG
1701 CGATC CCTGC GCCCT CAACC GCGC ATGAC CAGGT TCTCC GAGGA GGCGT
1751 GCGCG GTCCT GACGT CCCCC ACATT CGAGG CCTGC CATCG TGCCG TCAGC
```

-continued

```
1801 CCGCT GCCCT ACCTG CGGAA CTGCC GCTAC GACGT GTGCT CCTGC TCGGA
1851 CGGCC GCGAG TGCCT GTGCG GCGCC CTGGC CAGCT ATGCC GCGGC CTGCG
1901 CGGGG AGAGG CGTGC GCGTC GCGTG GCGCG AGCCA GGCCG CTGTG AGCTG
1951 AACTG CCCGA AAGGC CAGGT GTACC TGCAG TGCGG ACCCC CTGCA ACCT
2001 GACCT GCCGC TCTCT CTCTT ACCCG ATGAG GAAT GCAAT GAGGC CTGCC
2051 TGGAG GGCTG CTTCT GCCCC CAGG GCTCT ACATG GATGA GAGGG GGGAC
2101 TGCGT GCCCA AGGCC CAGTG CCCCT GTTAC TATGA CGGTG AGATC TTCCA
2151 GCCAG AAGAC ATCTT CTCAG ACCAT CACAC CATGT GCTAC TGTGA GGATG
2201 GCTTC ATGCA CTGTA CCATG AGTGG AGTCC CCGGA AGCTT GCTGC CTGAC
2251 GCTGT CCTCA GCAGT CCCCT GTCTC ATCGC AGCAA AAGGA GCCTA TCCTG
2301 TCGGC CCCCC ATGGT CAAGC TGGTG TGTCC CGCTG ACAAC CTGCG GGCTG
2351 AAGGG CTCGA GTGTA CCAAA CGTG CCAGA ACTAT GACCT GGAGT GCATG
2401 AGCAT GGGCT GTGTC TCTGG CTGCC TCTGC CCCCC GGGCA TGGTC CGGCA
2451 TGAGA ACAGA TGTGT GGCCC TGGAA AGGTG TCCCT GCTTC CATCA GGGCA
2501 AGGAG TATGC CCCTG GAGAA ACAGT GAAGA TTGGC TGCAA CACTT GTGTC
2551 TGTCG GGACC GGAAG TGGAA CTGCA CAGAC CATGT GTGTG ATGCC ACGTG
2601 CTCCA CGATC GGCAT GGCCC ACTAC CTCAC CTTCG ACGGG CTCAA ATACC
2651 TGTTC CCCGG GGAGT GCCAG TACGT TCTGG TGCAG GATTA CTGCG GCAGT
2701 AACCC TGGGA CCTTT CGGAT CCTAG TGGGG AATAA GGGAT GCAGC CACCC
2751 CTCAG TGAAA TGCAA GAAAC GGGTC ACCAT CCTGG TGGAG GGAGG AGAGA
2801 TTGAG CTGTT TGACG GGGAG GTGAA TGTGA AGAGG CCCAT GAAGG ATGAG
2851 ACTCA CTTTG AGGTG GTGGA GTCTG GCCGG TACAT CATTC TGCTG CTGGG
2901 CAAAG CCCTC TCCGT GGTCT GGGAC CGCCA CCTGA GCATC TCCGT GGTCC
2951 TGAAG CAGAC ATACC AGGAG AAAGT GTGTG GCCTG TGTGG AATT TGAT
3001 GGCAT CCAGA ACAAT GACCT CACCA GCAGC AACCT CCAAG TGGAG GAAGA
3051 CCCTG TGGAC TTTGG GAACT CCTGG AAAGT GAGCT CGCAG TGTGC TGACA
3101 CCAGA AAAGT GCCTC TGGAC TCATC CCCTG CCACC TGCCA TAACA CATC
3151 ATGAA GCAGA CGATG GTGGA TTCCT CCTGT AGAAT CCTTA CCAGT GACGT
3201 CTTCC AGGAC TGCAA CAAGC TGGTG ACCCC GAGCC ATAT CTGGA TGTCT
3251 GCATT TACGA CACCT GCTCC TGTGA GTCCA TTGGG GACTG GCCG CATTC
3301 TGCGA CACCA TTGCT GCCTA TGCCC ACGTG TGTGC CCAGC ATGGC AAGGT
3351 GGTGA CCTGG AGGAC GGCCA CATTG TGCCC CCAGA GCTGC GAGGA GAGGA
3401 ATCTC CGGGA GAACG GGTAT GAGGC TGAGT GGCGC TATAA CAGCT GTGCA
3451 CCTGC CTGTC AAGTC ACGTG TCAGC ACCCT GAGCC ACTGG CCTGC CCTGT
3501 GCAGT GTGTG GAGGG CTGCC ATGCC CACTG CCCTC CAGGG AAAAT CCTGG
3551 ATGAG CTTTT GCAGA CCTGC GTTGA CCCTG AAGAC TGTCC AGTGT GTGAG
3601 GTGGC TGGCC GGCGT TTTGC CTCAG GAAAG AAAGT CACCT GAAT CCCAG
3651 TGACC CTGAG CACTG CCAGA TTTGC CACTG TGATG TTGTC AACCT CACCT
3701 GTGAA GCCTG CCAGG AGCCG ATATC TGGCG GTGGA GGTTC CGGTG GCGGG
3751 GGATC CGGCG GTGGA GGTTC CGGCG GTGGA GGTTC CGGTG GCGGG GGATC
```

-continued

```
3801 CGGTG GCGGG GGATC CCTGG TCCCC CGGGG CAGCG GCGGT GGAGG TTCCG
3851 GTGGC GGGGG ATCCG ACAAA ACTCA CACAT GCCCA CCGTG CCCAG CTCCA
3901 GAACT CCTGG GCGGA CCGTC AGTCT TCCTC TTCCC CCCAA AACCC AAGGA
3951 CACCC TCATG GCCTC CCGGA CCCCT GAGGT CACAT GCGTG GTGGT GGACG
4001 TGAGC CACGA AGACC CTGAG GTCAA GTTCA ACTGG TACGT GGACG GCGTG
4051 GAGGT GCATA ATGCC AAGAC AAAGC CGCGG GAGGA GCAGT ACAAC AGCAC
4101 GTACC GTGTG GTCAG CGTCC TCACC GTCCT GCACC AGGAC TGGCT GAATG
4151 GCAAG GAGTA CAAGT GCAAG GTCTC AACAA AGCCC TCCCA GCCCC CATC
4201 GAGAA AACCA TCTCC AAAGC CAAAG GGCAG CCCCG AGAAC CACAG GTGTA
4251 CACCC TGCCC CCATC CCGCG ATGAG CTGAC CAAGA ACCAG GTCAG CCTGA
4301 CCTGC CTGGT CAAAG GCTTC TATCC CAGCG ACATC GCCGT GGAGT GGGAG
4351 AGCAA TGGGC AGCCG GAGAA CAACT ACAAG ACCAC GCCTC CCGTG TTGGA
4401 CTCCG ACGGC TCCTT CTTCC TCTAC AGCAA GCTCA CCGTG GACAA GAGCA
4451 GGTGG CAGCA GGGGA ACGTC TTCTC ATGCT CCGTG ATGCA TGAGG CTCTG
4501 CACAA CGCCT ACACG CAGAA GAGCC TCTCC CTGTC TCCGG GTAAA TGA
```
VWF050 protein sequence (IHH triple mutant)

(SEQ ID NO: 150)

```
   1 MIPARFAGVL LALALILPGT LCAEGTRGRS STARCSLFGS DFVNTFDGSM
  51 YSFAGYCSYL LAGGCQKRSF SIIGDFQNGK RVSLSVYLGE FFDIHLFVNG
 101 TVTQGDQRVS MPYASKGLYL EIEAGYYKLS GEAYGFVARI DGSGNFQVLL
 151 SDRYFNKTCG LCGNFNIFAE DDFMTQEGTL TSDPYDFANS WALSSGEQWC
 201 ERASPPSSSC NISSGEMQKG LWEQCQLLKS TSVFARCHPL VDPEPFVALC
 251 EKTLCECAGG LECACPALLE YARTCAQEGM VLYGWTDHSA CSPVCPAGME
 301 YRQCVSPCAR TCQSLHINEM CQERCVDGCS CPEGQLLDEG LCVESTECPC
 351 VHSGKRYPPG TSLSRDCNTC ICRNSQWICS NEECPGECLV TGQSHFKSFD
 401 NRYFTFSGIC QYLLARDCQD HSFSIVIETV QCADDRDAVC TRSVTVRLPG
 451 LHNSLVKLKH GAGVAMDGQD IQLPLLKGDL RIQHTVTASV RLSYGEDLQM
 501 DWDGRGRLLV KLSPVYAGKT CGLCGNYNGN QGDDFLTPSG LAEPRVEDFG
 551 NAWKLHGDCQ DLQKQHSDPC ALNPRMTRFS EEACAVLTSP TFEACHRAVS
 601 PLPYLRNCRY DVCSCSDGRE CLCGALASYA AACAGRGVRV AWREPGRCEL
 651 NCPKGQVYLQ CGTPCNLTCR SLSYPDEECN EACLEGCFCP PGLYMDERGD
 701 CVPKAQCPCY YDGEIFQPED IFSDHHTMCY CEDGFMHCTM SGVPGSLLPD
 751 AVLSSPLSHR SKRSLSCRPP MVKLVCPADN LRAEGLECTK TCQNYDLECM
 801 SMGCVSGCLC PPGMVRHENR CVALERCPCF HQGKEYAPGE TVKIGCNTCV
 851 CRDRKWNCTD HVCDATCSTI GMAHYLTFDG LKYLFPGECQ YVLVQDYCGS
 901 NPGTFRILVG NKGCSHPSVK CKKRVTILVE GGEIELFDGE VNVKRPMKDE
 951 THFEVVESGR YIILLLGKAL SVVWDRHLSI SVVLKQTYQE KVCGLCGNFD
1001 GIQNNDLTSS NLQVEEDPVD FGNSWKVSSQ CADTRKVPLD SSPATCHNNI
1051 MKQTMVDSSC RILTSDVFQD CNKLVDPEPY LDVCIYDTCS CESIGDCAAF
1101 CDTIAAYAHV CAQHGKVVTW RTATLCPQSC EERNLRENGY EAEWRYNSCA
```

-continued

```
1151 PACQVTCQHP EPLACPVQCV EGCHAHCPPG KILDELLQTC VDPEDCPVCE

1201 VAGRRFASGK KVTLNPSDPE HCQICHCDVV NLTCEACQEP ISGGGGSGGG

1251 GSGGGGSGGG GSGGGGSGGG GSLVPRGSGG GGSGGGGSDK THTCPPCPAP

1301 ELLGGPSVFL FPPKPKDTLM ASRTPEVTCV VVDVSHEDPE VKFNWYVDGV

1351 EVHNAKTKPR EEQYNSTYRV VSVLTVLAQD WLNGKEYKCK VSNKALPAPI

1401 EKTISKAKGQ PREPQVYTLP PSRDELTKNQ VSLTCLVKGF YPSDIAVEWE

1451 SNGQPENNYK TTPPVLDSDG SFFLYSKLTV DKSRWQQGNV FSCSVMHEAL

1501 HNAYTQKSLS LSPGK*
```

VWF057 nucleotide sequence (SEQ ID NO: 151)

```
   1 ATGAT TCCTG CCAGA TTTGC CGGGG TGCTG CTTGC TCTGG CCCTC ATTTT

51 GCCAG GGACC CTTTG TGCAG AAGGA ACTCG CGGCA GGTCA TCCAC GGCCC

101 GATGC AGCCT TTTCG GAAGT GACTT CGTCA ACACC TTTGA TGGGA GCATG

151 TACAG CTTTG CGGGA TACTG CAGTT ACCTC CTGGC AGGGG CTGCC CAGAA

201 ACGCT CCTTC TCGAT TATTG GGGAC TTCCA GAATG GCAAG AGAGT GAGCC

251 TCTCC GTGTA TCTTG GGGAA TTTTT TGACA TCCAT TTGTT TGTCA ATGGT

301 ACCGT GACAC AGGGG GACCA AAGAG TCTCC ATGCC CTATG CCTCC AAAGG

351 GCTGT ATCTA GAAAC TGAGG CTGGG TACTA CAAGC TGTCC GGTGA GGCCT

401 ATGGC TTTGT GGCCA GGATC GATGG CAGCG GCAAC TTTCA GTCCT GCTG

451 TCAGA CAGAT ACTTC AACAA GACCT GCGGG CTGTG TGGCA ACTTT AACAT

501 CTTTG CTGAA GATGA CTTTA TGACC CAAGA AGGGA CCTTG ACCTC GGACC

551 CTTAT GACTT TGCCA ACTCA TGGGC TCTGA GCAGT GGAGA ACAGT GGTGT

601 GAACG GGCAT CTCCT CCCAG CAGCT CATGC AACAT CTCCT CTGGG AAAAT

651 GCAGA AGGGC CTGTG GGAGC AGTGC CAGCT TCTGA AGAGC ACCTC GGTGT

701 TTGCC CGCTG CCACC CTCTG GTGGA CCCCG AGCCT TTTGT GGCCC TGTGT

751 GAGAA GACTT GTGTG AGTGT GCTGG GGGGG CTGGA GTGCG CCTGC CCTGC

801 CCTCC TGGAG TACGC CCGGA CCTGT GCCCA GGAGG AATGG TGCT GTACG

851 GCTGG ACCGA CCACA GCGCG TGCAG CCCAG TGTGC CCTGC TGGTA TGGAG

901 TATAG GCAGT GTGTG TCCCC TTGCG CCAGG ACCTG CCAGA GCCTG CACAT

951 CAATG AAATG TGTCA GGAGC GATGC GTGGA TGGCT GCAGC TGCCC TGAGG

1001 GACAG CTCCT GGATG AAGGC CTCTG CGTGG AGAGC ACCGA GTGTC CCTGC

1051 GTGCA TTCCG GAAAG CGCTA CCCTC CCGGC ACCTC CCTCT CTCGA GACTG

1101 CAACA CCTGC ATTTG CCGAA ACAGC CAGTG GATCT GCAGC AATGA AGAAT

1151 GTCCA GGGGA GTGCC TTGTC ACTGG TCAAT CCCAC TTCAA GAGCT TTGAC

1201 AACAG ATACT TCACC TTCAG TGGGA TCTGC CAGTA CCTGC TGGCC CGGGA

1251 TTGCC AGGAC CACTC CTTCT CCATT GTCAT TGAGA CTGTC CAGTG TGCTG

1301 ATGAC CGCGA CGCTG TGTGC ACCCG CTCCG TCACC GTCCG GCTGC CTGGC

1351 CTGCA CAACA GCCTT GTGAA ACTGA AGCAT GGGGC AGGAG TTGCC ATGGA

1401 TGGCC AGGAC ATCCA GCTCC CCTCC TGAA AGGTG ACCTC GCAT CCAGC

1451 ATACA GTGAC GGCCT CCGTG CGCCT CAGCT ACGGG AGGA CCTGC AGATG

1501 GACTG GGATG GCCGC GGGAG GCTGC TGGTG AAGCT GTCCC CGTC TATGC
```

```
1551  CGGGA AGACC TGCGG CCTGT GTGGG AATTA CAATG GCAAC CAGGG CGACG

1601  ACTTC CTTAC CCCCT CTGGG CTGGC GGAGC CCCGG GTGGA GGACT TCGGG

1651  AACGC CTGGA AGCTG CACGG GGACT GCCAG GACCT GCAGA AGCAG CACAG

1701  CGATC CCTGC GCCCT CAACC CGCGC ATGAC CAGGT TCTCC GAGGA GGCGT

1751  GCGCG GTCCT GACGT CCCCC ACATT CGAGG CCTGC CATCG TGCCG TCAGC

1801  CCGCT GCCCT ACCTG CGGAA CTGCC GCTAC GACGT GTGCT CCTGC TCGGA

1851  CGGCC GCGAG TGCCT GTGCG GCGCC CTGGC CAGCT ATGCC GCGGC CTGCG

1901  CGGGG AGAGG CGTGC GCGTC GCGTG GCGCG AGCCA GGCCG CTGTG AGCTG

1951  AACTG CCCGA AAGGC CAGGT GTACC TGCAG TGCGG ACCCC CTGCC AACCT

2001  GACCT GCCGC TCTCT CTCTT ACCCG GATGA GGAAT GCAAT GAGGG CTGCC

2051  TGGAG GGCTG CTTCT GCCCC CCAGG GCTCT ACATG GATGA GAGGG GGGAC

2101  TGCGT GCCCA AGGCC CAGTG CCCCT GTTAC TATGA CGGTG AGATC TTCCA

2151  GCCAG AAGAC ATCTT CTCAG ACCAT CACAC CATGT GCTAC TGTGA GGATG

2201  GCTTC ATGCA CTGTA CCATG AGTGG AGTCC CCGGA AGCTT GCTGC CTGAC

2251  GCTGT CCTCA GCAGT CCCCT GTCTC ATCGC AGCAA AAGGA GCCTA TCCTG

2301  TCGGC CCCCC ATGGT CAAGC TGGTG TGTCC CGCTG ACAAC CTGCG GGCTG

2351  AAGGG CTCGA GTGTA CCAAA ACGTG CCAGA ACTAT GACCT GGAGT GCATG

2401  AGCAT GGGCT GTGTC TCTGG CTGCC TCTGC CCCCC GGGCA TGGTC CGGCA

2451  TGAGA ACAGA TGTGT GGCCC TGGAA AGGTG TCCCT GCTTC ATCAG GGGCA

2501  AGGAG TATGC CCCTG AGAAA CAGT GAAGA TTGGC TGCAA CACTT GTGTC

2551  TGTCG GGACC GGAAG TGGAA CTGCA CAGAC CATGT GTGTG ATGCC ACGTG

2601  CTCCA CGATC GGCAT GGCCC ACTAC CTCAC CTTCG ACGGG CTCAA ATACC

2651  TGTTC CCCGG GGAGT GCCAG TACGT TCTGG TGCAG GATTA CTGCG GCAGT

2701  AACCC TGGGA CCTTT CGGAT CCTAG TGGGG AATAA GGGAT GCAGC CACCC

2751  CTCAG TGAAA TGCAA GAAAC GGGTC ACCAT CCTGG TGGAG GGAGG AGAGA

2801  TTGAG CTGTT TGACG GGGAG GTGAA TGTGA AGAGG CCCAT GAAGG ATGAG

2851  ACTCA CTTTG AGGTG GTGGA GTCTG GCCGG TACAT CATTC TGCTG CTGGG

2901  CAAAG CCCTC TCCGT GGTCT GGGAC CGCCA CCTGA GCATC TCCGT GGTCC

2951  TGAAG CAGAC ATACC AGGAG AAAGT GTGTG GCCTG TGTGG GAATT TTGAT

3001  GGCAT CCAGA ACAAT GACCT CACCA GCAGC AACCT CCAAG TGGAG GAAGA

3051  CCCTG TGGAC TTTGG GAACT CCTGG AAAGT GAGCT CGCAG TGTGC TGACA

3101  CCAGA AAAGT GCCTC TGGAC TCATC CCCTG CCACC TGCCA TAACA ACATC

3151  ATGAA GCAGA CGATG GTGGA TTCCT CCTGT AGAAT CCTTA CCAGT GACGT

3201  CTTCC AGGAC TGCAA CAAGC TGGTG GACCC CGAGC CATAT CTGGA TGTCT

3251  GCATT TACGA CACCT GCTCC TGTGA GTCCA TTGGG GACTG CGCCG CATTC

3301  TGCGA CACCA TTGCT GCCTA TGCCC ACGTG TGTGC CCAGC ATGGC AAGGT

3351  GGTGA CCTGG AGGAC GGCCA CATTG TGCCC CCAGA GCTGC GAGGA GAGGA

3401  ATCTC CGGGA GAACG GGTAT GAGGC TGAGT GGCGC TATAA CAGCT GTGCA

3451  CCTGC CTGTC AAGTC ACGTG TCAGC ACCCT GAGCC ACTGG CCTGC CCTGT
```

-continued

```
3501 GCAGT GTGTG GAGGG CTGCC ATGCC CACTG CCCTC CAGGG AAAAT CCTGG

3551 ATGAG CTTTT GCAGA CCTGC GTTGA CCCTG AAGAC TGTCC AGTGT GTGAG

3601 GTGGC TGGCC GGCGT TTTGC CTCAG GAAAG AAAGT CACCT TGAAT CCCAG

3651 TGACC CTGAG CACTG CCAGA TTTGC CACTG TGATG TTGTC AACCT CACCT

3701 GTGAA GCCTG CCAGG AGCCG ATATC GGGCG CGCCA ACATC AGAGA GCGCC

3751 ACCCC TGAAA GTGGT CCCGG GAGCG AGCCA GCCAC ATCTG GGTCG GAAAC

3801 GCCAG GCACA AGTGA GTCTG CAACT CCCGA GTCCG ACCT  GGCTC CGAGC

3851 CTGCC ACTAG CGGCT CCGAG ACTCC GGGAA CTTCC GAGAG CGCTA CACCA

3901 GAAAG CGGAC CCGGA ACCAG TACCG AACCT AGCGA GGGCT CTGCT CCGGG

3951 CAGCC CAGCC GGCTC TCCTA CATCC ACGGA GGAGG GCACT TCCGA ATCCG

4001 CCACC CCGGA GTCAG GGCCA GGATC TGAAC CCGCT ACCTC AGGCA GTGAG

4051 ACGCC AGGAA CGAGC GAGTC CGCTA CACCG AGAGA TGGGC CAGGG AGCCC

4101 TGCTG GATCT CCTAC GTCCA CTGAG GAAGG GTCAC CAGCG GGCTC GCCCA

4151 CCAGC ACTGA AGAAG GTGCC TCGAG CGGCG GTGGA GGTTC CGGTG GCGGG

4201 GGATC CGGTG GCGGG GGATC CGGTG GCGGG GGATC CGGTG GCGGG GGATC

4251 CCTGG TCCCC GGGGC AGCGG AGGC GACAA AACTC ACACA TGCCC ACCGT

4301 GCCCA GCTCC AGAAC TCCTG GGCGG ACCGT CAGTC TTCCT CTTCC CCCCA

4351 AAACC CAAGG ACACC CTCAT GATCT CCCGG ACCCC TGAGG TCACA TGCGT

4401 GGTGG TGGAC GTGAG CCACG AAGAC CCTGA GGTCA AGTTC AACTG GTACG

4451 TGGAC GGCGT GGAGG TGCAT AATGC AAGAC AAAG CCGCG GGAGG AGCAG

4501 TACAA CAGCA CGTAC CGTGT GGTCA GCGTC CTCAC CGTCC TGCAC CAGGA

4551 CTGGC TGAAT GGCAA GGAGT ACAAG TGCAA GGTCT CCAAC AAAGC CCTCC

4601 CAGCC CCCAT CGAGA AAACC ATCTC CAAAG CCAAA GGGCA GCCCC GAGAA

4651 CCACA GGTGT ACACC CTGCC CCCAT CCCGG GATGA GCTGA CCAAG AACCA

4701 GGTCA GCCTG ACCTG CCTGG TCAAA GGCTT CTATC CCAGC GACAT CGCCG

4751 TGGAG TGGGA GAGCA ATGGG CAGCC GGAGA ACAAC TACAA GACCA CGCCT

4801 CCCGT GTTGG ACTCC GACGG CTCCT TCTTC CTCTA CAGCA AGCTC ACCGT

4851 GGACA AGAGC AGGTG GCAGC AGGGG AACGT CTTCT CATGC TCCGT GATGC

4901 ATGAG GCTCT GCACA ACCAC TACAC GCAGA AGAGC CTCTC CCTGT CTCCG

4951 GGTAA ATGA
```

VWF057 protein sequence (SEQ ID NO: 152)

```
  1 MIPARFAGVL LALALILPGT LCAEGTRGRS STARCSLFGS DFVNTFDGSM

51 YSFAGYCSYL LAGGCQKRSF SIIGDFQNGK RVSLSVYLGE FFDIHLFVNG

101 TVTQGDQRVS MPYASKGLYL EIEAGYYKLS GEAYGFVARI DGSGNFQVLL

151 SDRYFNKTCG LCGNFNIFAE DDFMTQEGTL TSDPYDFANS WALSSGEQWC

201 ERASPPSSSC NISSGEMQKG LWEQCQLLKS TSVFARCHPL VDPEPFVALC

251 EKTLCECAGG LECACPALLE YARTCAQEGM VLYGWTDHSA CSPVCPAGME

301 YRQCVSPCAR TCQSLHINEM CQERCVDGCS CPEGQLLDEG LCVESTECPC

351 VHSGKRYPPG TSLSRDCNTC ICRNSQWICS NEECPGECLV TGQSHFKSFD

401 NRYFTFSGIC QYLLARDCQD HSFSIVIETV QCADDRDAVC TRSVTVRLPG
```

```
 451 LHNSLVKLKH GAGVAMDGQD IQLPLLKGDL RIQHTVTASV RLSYGEDLQM
 501 DWDGRGRLLV KLSPVYAGKT CGLCGNYNGN QGDDFLTPSG LAEPRVEDFG
 551 NAWKLHGDCQ DLQKQHSDPC ALNPRMTRFS EEACAVLTSP TFEACHRAVS
 601 PLPYLRNCRY DVCSCSDGRE CLCGALASYA AACAGRGVRV AWREPGRCEL
 651 NCPKGQVYLQ CGTPCNLTCR SLSYPDEECN EACLEGCFCP PGLYMDERGD
 701 CVPKAQCPCY YDGEIFQPED IFSDHHTMCY CEDGFMHCTM SGVPGSLLPD
 751 AVLSSPLSHR SKRSLSCRPP MVKLVCPADN LRAEGLECTK TCQNYDLECM
 801 SMGCVSGCLC PPGMVRHENR CVALERCPCF HQGKEYAPGE TVKIGCNTCV
 851 CRDRKWNCTD HVCDATCSTI GMAHYLTFDG LKYLFPGECQ YVLVQDYCGS
 901 NPGTFRILVG NKGCSHPSVK CKKRVTILVE GGEIELFDGE VNVKRPMKDE
 951 THFEVVESGR YIILLLGKAL SVVWDRHLSI SVVLKQTYQE KVCGLCGNFD
1001 GIQNNDLTSS NLQVEEDPVD FGNSWKVSSQ CADTRKVPLD SSPATCHNNI
1051 MKQTMVDSSC RILTSDVFQD CNKLVDPEPY LDVCIYDTCS CESIGDCAAF
1101 CDTIAAYAHV CAQHGKVVTW RTATLCPQSC EERNLRENGY EAEWRYNSCA
1151 PACQVTCQHP EPLACPVQCV EGCHAHCPPG KILDELLQTC VDPEDCPVCE
1201 VAGRRFASGK KVTLNPSDPE HCQICHCDVV NLTCEACQEP ISGAPTSESA
1251 TPESGPGSEP ATSGSETPGT SESATPESGP GSEPATSGSE TPGTSESATP
1301 ESGPGTS1EP SEGSAPGSPA GSPTS1EEGT SESATPESGP GSEPATSGSE
1351 TPGTSESATP ESGPGSPAGS PTSTEEGSPA GSPTSTEEGA SSGGGGSGGG
1401 GSGGGGSGGG GSGGGGSLVP RGSGGDKTHT CPPCPAPELL GGPSVFLFPP
1451 KPKDTLMISR TPEVTCVVVD VSHEDPEVKF NWYVDGVEVH NAKTKPREEQ
1501 YNSTYRVVSV LTVLHQDWLN GKEYKCKVSN KALPAPIEKT ISKAKGQPRE
1551 PQVYTLPPSR DELTKNQVSL TCLVKGFYPS DIAVEWESNG QPENNYKTTP
1601 PVLDSDGSFF LYSKLTVDKS RWQQGNVFSC SVMHEALHNH YTQKSLSLSP
1651 GK*
```

VWF058 nucleotide sequence (VWF034 with IHH mutation)
(SEQ ID NO: 153)

```
  1 ATGAT TCCTG CCAGA TTTGC CGGGG TGCTG CTTGC TCTGG CCCTC ATTTT
 51 GCCAG GGACC CTTTG TGCAG AAGGA ACTCG CGGCA GGTCA TCCAC GGCCC
101 GATGC AGCCT TTTCG GAAGT GACTT CGTCA CACCT TTGA TGGGA GCATG
151 TACAG CTTTG CGGGA TACTG CAGTT ACCTC CTGGC AGGGG CTGC CAGAA
201 ACGCT CCTTC TCGAT TATTG GGGAC TTCCA GAATG GCAAG AGAGT GAGCC
251 TCTCC GTGTA TCTTG GGGAA TTTTT TGACA TCCAT TTGTT TGTCA ATGGT
301 ACCGT GACAC AGGGG GACCA AAGAG TCTCC ATGCC TATG CCTCC AAAGG
351 GCTGT ATCTA GAAAC TGAGG CTGGG TACTA CAAGC TGTCC GGTGA GGCCT
401 ATGGC TTTGT GGCCA GGATC GATGG CAGCG GCAAC TTTCA GTCC TGCTG
451 TCAGA CAGAT ACTTC AACAA GACCT GCGGG CTGTG TGGCA ACTTT AACAT
501 CTTTG CTGAA GATGA CTTTA TGACC CAAGA AGGGA CCTTG ACCTC GGACC
551 CTTAT GACTT TGCCA ACTCA TGGGC TCTGA GCAGT GGAGA ACAGT GGTGT
601 GAACG GGCAT CTCCT CCCAG CAGCT CATGC AACAT CTCCT CTGGG GAAAT
```

-continued

```
 651 GCAGA AGGGC CTGTG GGAGC AGTGC CAGCT TCTGA AGAGC ACCTC GGTGT
 701 TTGCC CGCTG CCACC CTCTG GTGGA CCCCG AGCCT TTTGT GGCCC TGTGT
 751 GAGAA GACTT TGTGT GAGTG TGCTG GGGGG CTGGA GTGCG CCTGC CCTGC
 801 CCTCC TGGAG TACGC CCGGA CCTGT GCCCA GGAGG AATG GTGCT GTACG
 851 GCTGG ACCGA CCACA GCGCG TGCAG CCCAG TGTGC CCTGC TGGTA TGGAG
 901 TATAG CAGT GTGTG TCCCC TTGCG CCAGG ACCTG CCAGA GCCTG CACAT
 951 CAATG AAATG TGTCA GGAGC GATGC GTGGA TGGCT GCAGC TGCCC TGAGG
1001 GACAG CTCCT GGATG AAGGC CTCTG CGTGG AGAGC ACCGA GTGTC CCTGC
1051 GTGCA TTCCG GAAAG CGCTA CCCTC CCGGC ACCTC CCTCT CTCGA GACTG
1101 CAACA CCTGC ATTTG CCGAA ACAGC CAGTG GATCT GCAGC AATGA AGAAT
1151 GTCCA GGGGA GTGCC TTGTC ACTGG TCAAT CCCAC TTCAA GAGCT TTGAC
1201 AACAG ATACT TCACC TTCAG TGGGA TCTGC AGTA CCTGC TGGCC CGGGA
1251 TTGCC AGGAC CACTC CTTCT CCATT GTCAT TGAGA CTGTC CAGTG TGCTG
1301 ATGAC CGCGA CGCTG TGTGC ACCCG CTCCG TCACC GTCCG GCTGC CTGGC
1351 CTGCA CAACA GCCTT GTGAA ACTGA AGCAT GGGGC AGGAG TTGCC ATGGA
1401 TGGCC AGGAC ATCCA GCTCC CCCTC CTGAA AGGTG ACCTC CGCAT CCAGC
1451 ATACA GTGAC GGCCT CCGTG CGCCT CAGCT ACGGG AGGA CCTGC AGATG
1501 GACTG GGATG GCCGC GGGAG GCTGC TGGTG AAGCT GTCCC CCGTC TATGC
1551 CGGGA AGACC TGCGG CCTGT GTGGG AATTA CAATG CAAC CAGGG CGACG
1601 ACTTC CTTAC CCCCT CTGGG CTGGC GGAGC CCCGG GTGGA GGACT TCGGG
1651 AACGC CTGGA AGCTG CACGG GGACT GCCAG ACCTG CAGA AGCAG CACAG
1701 CGATC CCTGC GCCCT CAACC GCGC ATGAC CAGGT TCTCC GAGGA GGCGT
1751 GCGCG GTCCT GACGT CCCCC ACATT CGAGG CCTGC CATCG TGCCG TCAGC
1801 CCGCT GCCCT ACCTG CGGAA CTGCC GCTAC GACGT GTGCT CCTGC TCGGA
1851 CGGCC GCGAG TGCCT GTGCG CGCC CTGGC CAGCT ATGCC GCGGC CTGCG
1901 CGGGG AGAGG CGTGC GCGTC GCGTG GCGCG AGCCA GGCCG CTGTG AGCTG
1951 AACTG CCCGA AAGGC CAGGT GTACC TGCAG TGCGG ACCC CCTGC AACCT
2001 GACCT GCCGC TCTCT CTCTT ACCCG GATGA GGAAT GCAAT GAGGC CTGCC
2051 TGGAG GGCTG CTTCT GCCCC CAGG GCTCT ACATG GATGA GAGGG GGGAC
2101 TGCGT GCCCA AGGCC CAGTG CCCCT GTTAC TATGA CGGTG AGATC TTCCA
2151 GCCAG AAGAC ATCTT CTCAG ACCAT CACAC CATGT GCTAC TGTGA GGATG
2201 GCTTC ATGCA CTGTA CCATG AGTGG AGTCC CCGGA AGCTT GCTGC CTGAC
2251 GCTGT CCTCA GCAGT CCCCT GTCTC ATCGC AGCAA AAGGA GCCTA TCCTG
2301 TCGGC CCCCC ATGGT CAAGC TGGTG TGTCC CGCTG ACAAC CTGCG GGCTG
2351 AAGGG CTCGA GTGTA CCAAA ACGTG CCAGA ACTAT GACCT GGAGT GCATG
2401 AGCAT GGGCT GTGTC TCTGG CTGCC TCTGC CCCCC GGGCA TGGTC CGGCA
2451 TGAGA ACAGA TGTGT GGCCC TGGAA AGGTG TCCCT GCTTC ATCA GGGCA
2501 AGGAG TATGC CCCTG AGAA ACAGT GAAGA TTGGC TGCAA CACTT GTGTC
2551 TGTCG GGACC GGAAG TGGAA CTGCA CAGAC CATGT GTGTG ATGCC ACGTG
2601 CTCCA CGATC GGCAT GGCCC ACTAC CTCAC CTTCG ACGGG CTCAA ATACC
```

```
2651 TGTTC CCCGG GGAGT GCCAG TACGT TCTGG TGCAG GATTA CTGCG GCAGT
2701 AACCC TGGGA CCTTT CGGAT CCTAG TGGGG AATAA GGGAT GCAGC CACCC
2751 CTCAG TGAAA TGCAA GAAAC GGGTC ACCAT CCTGG TGGAG GGAGG AGAGA
2801 TTGAG CTGTT TGACG GGGAG GTGAA TGTGA AGAGG CCCAT GAAGG ATGAG
2851 ACTCA CTTTG AGGTG GTGGA GTCTG GCCGG TACAT CATTC TGCTG CTGGG
2901 CAAAG CCCTC TCCGT GGTCT GGGAC CGCCA CCTGA GCATC TCCGT GGTCC
2951 TGAAG CAGAC ATACC AGGAG AAAGT GTGTG CCTG TGTGG GAATT TTGAT
3001 GGCAT CCAGA ACAAT GACCT CACCA GCAGC AACCT CCAAG TGGAG GAAGA
3051 CCCTG TGGAC TTTGG GAACT CCTGG AAAGT GAGCT CGCAG TGTGC TGACA
3101 CCAGA AAAGT GCCTC TGGAC TCATC CCCTG CCACC TGCCA TAACA ACATC
3151 ATGAA GCAGA CGATG GTGGA TTCCT CCTGT AGAAT CCTTA CCAGT GACGT
3201 CTTCC AGGAC TGCAA CAAGC TGGTG ACCCC GAGCC ATAT CTGGA TGTCT
3251 GCATT TACGA CACCT GCTCC TGTGA GTCCA TTGGG GACTG CGCCG CATTC
3301 TGCGA CACCA TTGCT GCCTA TGCCC ACGTG TGTGC CCAGC ATGGC AAGGT
3351 GGTGA CCTGG AGGAC GGCCA CATTG TGCCC CCAGA GCTGC GAGGA GAGGA
3401 ATCTC CGGGA GAACG GGTAT GAGGC TGAGT GGCGC TATAA CAGCT GTGCA
3451 CCTGC CTGTC AAGTC ACGTG TCAGC ACCCT GAGCC ACTGG CCTGC CCTGT
3501 GCAGT GTGTG GAGGG CTGCC ATGCC CACTG CCCTC CAGGG AAAAT CCTGG
3551 ATGAG CTTTT GCAGA CCTGC GTTGA CCCTG AAGAC TGTCC AGTGT GTGAG
3601 GTGGC TGGCC GGCGT TTTGC CTCAG GAAAG AAAGT CACCT TGAAT CCCAG
3651 TGACC CTGAG CACTG CCAGA TTTGC CACTG TGATG TTGTC AACCT CACCT
3701 GTGAA GCCTG CCAGG AGCCG ATATC GGGTA CCTCA GAGTC TGCTA CCCCC
3751 GAGTC AGGGC CAGGA TCAGA GCCAG CCACC TCCGG GTCTG AGACA CCCGG
3801 GACTT CCGAG AGTGC ACCCC CTGAG TCCGG ACCCG GTCC GAGCC CGCCA
3851 CTTCC GGCTC CGAAA CTCCC GGCAC AAGCG AGAGC GCTAC CCCAG AGTCA
3901 GGACC AGGAA CATCT ACAGA GCCCT CTGAA GGCTC CGCTC CAGGG TCCCC
3951 AGCCG GCAGT CCCAC TAGCA CCGAG GAGGG AACCT CTGAA AGCGC CACAC
4001 CCGAA TCAGG GCCAG GGTCT GAGCC TGCTA CCAGC GGCAG CGAGA CACCA
4051 GGCAC CTCTG AGTCC GCCAC ACCAG AGTCC GGACC CGGAT CTCCC GCTGG
4101 GAGCC CCACC TCCAC TGAGG AGGGA TCTCC TGCTG GCTCT CCAAC ATCTA
4151 CTGAG GAAGG TACCT CAACC GAGCC ATCCG AGGGA TCAGC TCCCG CACC
4201 TCAGA GTCGG CAACC CCGGA GTCTG GACCC GGAAC TTCCG AAAGT GCCAC
4251 ACCAG AGTCC GGTCC CGGGA CTTCA GAATC AGCAA CACCC GAGTC CGGCC
4301 CTGGG TCTGA ACCCG CCACA AGTGG TAGTG AGACA CCAGG ATCAG AACCT
4351 GCTAC CTCAG GGTCA GAGAC ACCCG GATCT CCGGC AGGCT CACCA ACCTC
4401 CACTG AGGAG GGCAC CAGCA CAGAA CCAAG CGAGG CTCC GCACC CGGAA
4451 CAAGC ACTGA ACCCA GTGAG GGTTC AGCAC CCGGC TCTGA GCCGG CCACA
4501 AGTGG CAGTG AGACA CCCGG CACTT CAGAG AGTGC CACCC CGAG AGTGG
4551 CCCAG GCACT AGTAC CGAGC CCTCT GAAGG CAGTG CGCCA GATTC TGGCG
```

```
4601 GTGGA GGTTC CGGTG GCGGG GGATC CGGTG GCGGG GGATC CGGTG GCGGG

4651 GGATC CGGTG GCGGG GGATC CCTGG TCCCC CGGGG CAGCG GAGGC GACAA

4701 AACTC ACACA TGCCC ACCGT GCCCA GCTCC AGAAC TCCTG GGCGG ACCGT

4751 CAGTC TTCCT CTTCC CCCCA AAACC CAAGG ACACC CTCAT GGCCT CCCGG

4801 ACCCC TGAGG TCACA TGCGT GGTGG TGGAC GTGAG CCACG AAGAC CCTGA

4851 GGTCA AGTTC AACTG GTACG TGGAC GGCGT GGAGG TGCAT AATGC CAAGA

4901 CAAAG CCGCG GGAGG AGCAG TACAA CAGCA CGTAC CGTGT GGTCA GCGTC

4951 CTCAC CGTCC TGGCC CAGGA CTGGC TGAAT GGCAA GGAGT ACAAG TGCAA

5001 GGTCT CCAAC AAAGC CCTCC CAGCC CCCAT CGAGA AAACC ATCTC CAAAG

5051 CCAAA GGGCA GCCCC GAGAA CCACA GGTGT ACACC CTGCC CCCAT CCCGC

5101 GATGA GCTGA CCAAG AACCA GGTCA GCCTG ACCTG CCTGG TCAAA GGCTT

5151 CTATC CCAGC GACAT CGCCG TGGAG TGGGA GAGCA ATGGG CAGCC GGAGA

5201 ACAAC TACAA GACCA CGCCT CCCGT GTTGG ACTCC GACGG CTCCT TCTTC

5251 CTCTA CAGCA AGCTC ACCGT GGACA AGAGC AGGTG GCAGC AGGGG AACGT

5301 CTTCT CATGC TCCGT GATGC ATGAG GCTCT GCACA ACGCC TACAC GCAGA

5351 AGAGC CTCTC CCTGT CTCCG GGTAA ATGA
```

VWF058 protein sequence (VWF034 with IHH mutation)

(SEQ ID NO: 154)

```
   1 MIPARFAGVL LALALILPGT LCAEGTRGRS STARCSLFGS DFVNTFDGSM

51 YSFAGYCSYL LAGGCQKRSF SIIGDFQNGK RVSLSVYLGE FFDIHLFVNG

101 TVTQGDQRVS MPYASKGLYL EIEAGYYKLS GEAYGFVARI DGSGNFQVLL

151 SDRYFNKTCG LCGNFNIFAE DDFMTQEGTL TSDPYDFANS WALSSGEQWC

201 ERASPPSSSC NISSGEMQKG LWEQCQLLKS TSVFARCHPL VDPEPFVALC

251 EKTLCECAGG LECACPALLE YARTCAQEGM VLYGWTDHSA CSPVCPAGME

301 YRQCVSPCAR TCQSLHINEM CQERCVDGCS CPEGQLLDEG LCVESTECPC

351 VHSGKRYPPG TSLSRDCNTC ICRNSQWICS NEECPGECLV TGQSHFKSFD

401 NRYFTFSGIC QYLLARDCQD HSFSIVIETV QCADDRDAVC TRSVTVRLPG

451 LHNSLVKLKH GAGVAMDGQD IQLPLLKGDL RIQHTVTASV RLSYGEDLQM

501 DWDGRGRLLV KLSPVYAGKT CGLCGNYNGN QGDDFLTPSG LAEPRVEDFG

551 NAWKLHGDCQ DLQKQHSDPC ALNPRMTRFS EEACAVLTSP TFEACHRAVS

601 PLPYLRNCRY DVCSCSDGRE CLCGALASYA AACAGRGVRV AWREPGRCEL

651 NCPKGQVYLQ CGTPCNLTCR SLSYPDEECN EACLEGCFCP PGLYMDERGD

701 CVPKAQCPCY YDGEIFQPED IFSDHHTMCY CEDGFMHCTM SGVPGSLLPD

751 AVLSSPLSHR SKRSLSCRPP MVKLVCPADN LRAEGLECTK TCQNYDLECM

801 SMGCVSGCLC PPGMVRHENR CVALERCPCF HQGKEYAPGE TVKIGCNTCV

851 CRDRKWNCTD HVCDATCSTI GMAHYLTFDG LKYLFPGECQ YVLVQDYCGS

901 NPGTFRILVG NKGCSHPSVK CKKRVTILVE GGEIELFDGE VNVKRPMKDE

951 THFEVVESGR YIILLLGKAL SVVWDRHLSI SVVLKQTYQE KVCGLCGNFD

1001 GIQNNDLTSS NLQVEEDPVD FGNSWKVSSQ CADTRKVPLD SSPATCHNNI

1051 MKQTMVDSSC RILTSDVFQD CNKLVDPEPY LDVCIYDTCS CESIGDCAAF

1101 CDTIAAYAHV CAQHGKVVTW RTATLCPQSC EERNLRENGY EAEWRYNSCA
```

```
1151 PACQVTCQHP EPLACPVQCV EGCHAHCPPG KILDELLQTC VDPEDCPVCE

1201 VAGRRFASGK KVTLNPSDPE HCQICHCDVV NLTCEACQEP ISGTSESATP

1251 ESGPGSEPAT SGSETPGTSE SATPESGPGS EPATSGSETP GTSESATPES

1301 GPGTSIEPSE GSAPGSPAGS PTSIEEGTSE SATPESGPGS EPATSGSETP

1351 GTSESATPES GPGSPAGSPT SIEEGSPAGS PTSTEEGTST EPSEGSAPGT

1401 SESATPESGP GTSESATPES GPGTSESATP ESGPGSEPAT SGSETPGSEP

1451 ATSGSETPGS PAGSPTSIEE GTSIEPSEGS APGTSIEPSE GSAPGSEPAT

1501 SGSETPGTSE SATPESGPGT SIEPSEGSAP DSGGGGSGGG GSGGGGSGGG

1551 GSGGGGSLVP RGSGGDKTHT CPPCPAPELL GGPSVFLFPP KPKDTLMASR

1601 TPEVTCVVVD VSHEDPEVKF NWYVDGVEVH NAKTKPREEQ YNSTYRVVSV

1651 LTVLAQDWLN GKEYKCKVSN KALPAPIEKT ISKAKGQPRE PQVYTLPPSR

1701 DELTKNQVSL TCLVKGFYPS DIAVEWESNG QPENNYKTTP PVLDSDGSFF

1751 LYSKLTVDKS RWQQGNVFSC SVMHEALHNA YTQKSLSLSP GK*
```

FVIII 169 nucleotide sequence (SEQ ID NO: 155)

```
   1 ATGCA AATAG AGCTC TCCAC CTGCT TCTTT CTGTG CCTTT TGCGA TTCTG

51 CTTTA GTGCC ACCAG AAGAT ACTAC CTGGG TGCAG TGGAA CTGTC ATGGG

101 ACTAT ATGCA AAGTG ATCTC GGTGA GCTGC CTGTG ACGCA AGAT TTCCT

151 CCTAG AGTGC CAAAA TCTTT TCCAT TCAAC ACCTC AGTCG TGTAC AAAAA

201 GACTC TGTTT GTAGA ATTCA CGGAT CACCT TTTCA ACATC GCTAA GCCAA

251 GGCCA CCCTG GATGG GTCTG CTAGG TCCTA CCATC CAGGC TGAGG TTTAT

301 GATAC AGTGG TCATT ACACT TAAGA ACATG GCTTC CCATC CTGTC AGTCT

351 TCATG CTGTT GGTGT ATCCT ACTGG AAAGC TTCTG AGGGA GCTGA ATATG

401 ATGAT CAGAC CAGTC AAAGG GAGAA AGAAG ATGAT AAAGT CTTCC CTGGT

451 GGAAG CCATA CATAT GTCTG GCAGG TCCTG AAAGA GAATG GTCCA ATGGC

501 CTCTG ACCCA CTGTG CCTTA CCTAC TCATA TCTTT CTCAT GTGGA CCTGG

551 TAAAA GACTT GAATT CAGGC CTCAT GGAG CCCTA CTAGT ATGTA GAGAA

601 GGGAG TCTGG CCAAG GAAAA GACAC AGACC TTGCA CAAAT TTATA CTACT

651 TTTTG CTGTA TTTGA TGAAG GGAAA AGTTG GCACT CAGAA ACAAA GAACT

701 CCTTG ATGCA GGATA GGGAT GCTGC ATCTG CTCGG GCCTG GCCTA AATG

751 CACAC AGTCA ATGGT TATGT AAACA GGTCT CTGCC AGGTC TGATT GGATG

801 CCACA GGAAA TCAGT CTATT GGCAT GTGAT GGAAT GGGC ACCAC TCCTG

851 AAGTG CACTC AATAT CCTCC GAAGG TCACA CATTT CTTGT GAGGA ACCAT

901 CGCCA GGCTA GCTTG GAAAT CTCGC CAATA ACTTT CCTTA CTGCT CAAAC

951 ACTCT TGATG GACCT GGACA GTTTC TACT GTTTT GTCAT ATCTC TTCCC

1001 ACCAA CATGA TGGCA TGGAA GCTTA TGTCA AAGTA GACAG CTGTC CAGAG

1051 GAACC CCAAC TACGA ATGAA AAATA TGAA GAAGC GGAAG ACTAT GATGA

1101 TGATC TTACT GATTC TGAAA TGGAT GTGGT CAGGT TTGAT GATGA CAACT

1151 CTCCT TCCTT TATCC AAATT CGCTC AGTTG CCAAG AAGCA TCCTA AAACT

1201 TGGGT ACATT ACATT GCTGC TGAAG AGGAG GACTG GGACT ATGCT CCCTT
```

-continued

```
1251 AGTCC TCGCC CCCGA TGACA GAAGT TATAA AAGTC AATAT TTGAA CAATG
1301 GCCCT CAGCG GATTG GTAGG AAGTA CAAAA AAGTC CGATT TATGG CATAC
1351 ACAGA TGAAA CCTTT AAGAC TCGTG AAGCT ATTCA GCATG AATCA GGAAT
1401 CTTGG GACCT TTACT TTATG GGGAA GTTGG AGACA CACTG TTGAT TATAT
1451 TTAAG AATCA AGCAA GCAGA CCATA TAACA TCTAC CCTCA CGGAA TCACT
1501 GATGT CCGTC CTTTG TATTC AAGGA GATTA CCAAA AGGTG TAAAA CATTT
1551 GAAGG ATTTT CCAAT TCTGC CAGGA GAAAT ATTCA AATAT AAATG GACAG
1601 TGACT GTAGA AGATG GGCCA ACTAA ATCAG ATCCT CGGTG CCTGA CCCGC
1651 TATTA CTCTA GTTTC GTTAA TATGG AGAGA GATCT AGCTT CAGGA CTCAT
1701 TGGCC CTCTC CTCAT CTGCT ACAAA GAATC TGTAG ATCAA AGAGG AAACC
1751 AGATA ATGTC AGACA GAGGG AATGT CATCC TGTTT TCTGT ATTTG ATGAG
1801 AACCG AAGCT GGTAC CTCAC AGAGA ATATA CAACG CTTTC TCCCC AATCC
1851 AGCTG GAGTG CAGCT TGAGG ATCCA GAGTT CCAAG CCTCC AACAT CATGC
1901 ACAGC ATCAA TGGCT ATGTT TTTGA TAGTT TGCAG TTGTC AGTTT GTTTG
1951 CATGA GGTGG CATAC TGGTA CATTC TAAGC ATTGG AGCAC AGACT GACTT
2001 CCTTT CTGTC TTCTT CTCTG GATAT ACCTT CAAAC ACAAA ATGGT CTATG
2051 AAGAC ACACT CACCC TATTC CCATT CTCAG GAGAA ACTGT CTTCA TGTCG
2101 ATGGA AAACC CAGGT CTATG GATTC TGGGG TGCCA CAACT CAGAC TTTCG
2151 GAACA GAGGC ATGAC CGCCT TACTG AAGGT TTCTA GTTGT GACAA GAACA
2201 CTGGT GATTA TTACG AGGAC AGTTA TGAAG ATATT TCAGC ATACT TGCTG
2251 AGTAA AAACA ATGCC ATTGA ACCAA GAAGC TTCTC TCAAA ACGGC GCGCC
2301 AGGTA CCTCA GAGTC TGCTA CCCCC GAGTC AGGGC AGGA TCAGA GCCAG
2351 CCACC TCCGG GTCTG AGACA CCCGG GACTT CCGAG AGTGC CACCC TGAG
2401 TCCGG ACCCG GGTCC GAGCC CGCCA CTTCC GGCTC CGAAA CTCCC GGCAC
2451 AAGCG AGAGC GCTAC CCCAG AGTCA GGACC AGGAA CATCT ACAGA GCCCT
2501 CTGAA GGCTC CGCTC CAGGG TCCCC AGCCG GCAGT CCCAC TAGCA CCGAG
2551 GAGGG AACCT CTGAA AGCGC ACAC CCGAA TCAGG GCCAG GGTCT GAGCC
2601 TGCTA CCAGC GGCAG CGAGA CACCA GGCAC CTCTG AGTCC GCCAC ACCAG
2651 AGTCC GGACC CGGAT CTCCC GCTGG GAGCC CCACC TCCAC TGAGG AGGGA
2701 TCTCC TGCTG GCTCT CCAAC ATCTA CTGAG GAAGG TACCT CAACC GAGCC
2751 ATCCG AGGGA TCAGC TCCCG GCACC TCAGA GTCGG CAACC CCGGA GTCTG
2801 GACCC GGAAC TTCCG AAAGT GCCAC ACCAG AGTCC GGTCC CGGGA CTTCA
2851 GAATC AGCAA CACCC GAGTC CGGCC CTGGG TCTGA ACCCG CCACA AGTGG
2901 TAGTG AGACA CCAGG ATCAG AACCT GCTAC CTCAG GGTCA GAGAC ACCCG
2951 GATCT CCGGC AGGCT CACCA ACCTC CACTG AGGAG GGCAC CAGCA CAGAA
3001 CCAAG CGAGG GCTCC GCACC CGGAA CAAGC ACTGA ACCCA GTGAG GGTTC
3051 AGCAC CCGGC TCTGA GCCGG CCACA GTGGG CAGTG AGACA CCCGG CACTT
3101 CAGAG AGTGC CACCC CGAGA GTGGG CCCAG GCACT AGTAC CGAGC CCTCT
3151 GAAGG CAGTG CGCCA GCCTC GAGCC CACCA GTCTT GAAAC GCCAT CAAGC
3201 TGAAA TAACT CGTAC TACTC TTCAG TCAGA TCAAG AGGAA ATCGA TTATG
```

```
3251 ATGAT ACCAT ATCAG TTGAA ATGAA GAAGG AAGAT TTTGA CATTT ATGAT
3301 GAGGA TGAAA ATCAG AGCCC CCGCA GCTTT CAAAA GAAAA CACGA CACTA
3351 TTTTA TTGCT GCAGT GGAGA GGCTC TGGGA TTATG GGATG AGTAG CTCCC
3401 CACAT GTTCT AAGAA ACAGG GCTCA GAGTG GCAGT GTCCC TCAGT TCAAG
3451 AAAGT TGTTT TCCAG GAATT TACTG ATGGC TCCTT TACTC AGCCC TTATA
3501 CCGTG GAGAA CTAAA TGAAC ATTTG GGACT CCTGG GGCCA TATAT AAGAG
3551 CAGAA GTTGA AGATA ATATC ATGGT AACTT TCAGA AATCA GGCCT CTCGT
3601 CCCTA TTCCT TCTAT TCTAG CCTTA TTTCT TATGA GGAAG ATCAG AGGCA
3651 AGGAG CAGAA CCTAG AAAAA ACTTT GTCAA GCCTA ATGAA ACCAA AACTT
3701 ACTTT TGGAA AGTGC AACAT CATAT GGCAC CCACT AAAGA TGAGT TTGAC
3751 TGCAA AGCCT GGGCT TATTT CTCTG ATGTT GACCT GGAAA AAGAT GTGCA
3801 CTCAG GCCTG ATTGG ACCCC TTCTG GTCTG CCACA CTAAC ACACT GAACC
3851 CTGCT CATGG GAGAC AAGTG ACAGT ACAGG AATTT GCTCT GTTTT TCACC
3901 ATCTT TGATG AGACC AAAAG CTGGT ACTTC ACTGA AAATA TGGAA AGAAA
3951 CTGCA GGGCT CCCTG CAATA TCCAG ATGGA AGATC CCACT TTTAA AGAGA
4001 ATTAT CGCTT CCATG CAATC AATGG CTACA TAATG GATAC ACTAC CTGGC
4051 TTAGT AATGG CTCAG GATCA AAGGA TTCGA TGGTA TCTGC TCAGC ATGGG
4101 CAGCA ATGAA AACAT CCATT CTATT CATTT CAGTG GACAT GTGTT CACTG
4151 TACGA AAAAA AGAGG AGTAT AAAAT GGCAC TGTAC AATCT CTATC CAGGT
4201 GTTTT TGAGA CAGTG GAAAT GTTAC CATCC AAAGC TGGAA TTTGG CGGGT
4251 GGAAT GCCTT ATTGG CGAGC ATCTA CATGC TGGGA TGAGC ACACT TTTTC
4301 TGGTG TACAG CAATA AGTGT CAGAC TCCCC TGGGA ATGGC TTCTG GACAC
4351 ATTAG AGATT TTCAG ATTAC AGCTT CAGGA CAATA TGGAC AGTGG GCCCC
4401 AAAGC TGGCC AGACT TCATT ATTCC GGATC AATCA ATGCC TGGAG CACCA
4451 AGGAG CCCTT TTCTT GGATC AAGGT GGATC TGTTG GCACC AATGA TTATT
4501 CACGG CATCA AGACC CAGGG TGCCC GTCAG AAGTT CTCCA GCCTC TACAT
4551 CTCTC AGTTT ATCAT CATGT ATAGT CTTGA TGGGA AGAAG TGGCA GACTT
4601 ATCGA GGAAA TTCCA CTGGA ACCTT AATGG TCTTC TTTGG CAATG TGGAT
4651 TCATC TGGGA TAAAA CACAA TATTT TTAAC CCTCC AATTA TTGCT CGATA
4701 CATCC GTTTG CACCC AACTC ATTAT AGCAT CGCAG CACT CTTCG CATGG
4751 AGTTG ATGGG CTGTG ATTTA AATAG TTGCA GCATG CCATT GGGAA TGGAG
4801 AGTAA AGCAA TATCA GATGC ACAGA TTACT GCTTC ATCCT ACTTT ACCAA
4851 TATGT TTGCC ACCTG GTCTC CTTCA AAAGC TCGAC TTCAC CTCCA AGGGA
4901 GGAGT AATGC CTGGA GACCT CAGGT GAATA ATCCA AAAGA GTGGC TGCAA
4951 GTGGA CTTCC AGAAG ACAAT GAAAG TCACA GGAGT AACTA CTCAG GGAGT
5001 AAAAT CTCTG CTTAC CAGCA TGTAT GTGAA GGAGT TCCTC ATCTC CAGCA
5051 GTCAA GATGG CCATC AGTGG ACTCT CTTTT TTCAG AATGG CAAAG TAAAG
5101 GTTTT TCAGG GAAAT CAAGA CTCCT TCACA CCTGT GGTGA ACTCT CTAGA
5151 CCCAC CGTTA CTGAC TCGCT ACCTT CGAAT TCACC CCCAG AGTTG GGTGC
```

```
5201 ACCAG ATTGC CCTGA GGATG GAGGT TCTGG GCTGC GAGGC ACAGG ACCTC
5251 TACGA CAAAA CTCAC ACATG CCCAC CGTGC CCAGC TCCAG AACTC CTGGG
5301 CGGAC CGTCA GTCTT CCTCT TCCCC CCAAA ACCCA AGGAC ACCCT CATGA
5351 TCTCC CGGAC CCCTG AGGTC ACATG CGTGG TGGTG GACGT GAGCC ACGAA
5401 GACCC TGAGG TCAAG TTCAA CTGGT ACGTG GACGG CGTGG AGGTG CATAA
5451 TGCCA AGACA AAGCC GCGGG AGGAG CAGTA CAACA GCACG TACCG TGTGG
5501 TCAGC GTCCT CACCG TCCTG CACCA GGACT GGCTG AATGG CAAGG AGTAC
5551 AAGTG CAAGG TCTCC AACAA AGCCC TCCCA GCCCC CATCG AGAAA ACCAT
5601 CTCCA AAGCC AAAGG GCAGC CCCGA GAACC ACAGG TGTAC ACCCT GCCCC
5651 CATCC CGGGA TGAGC TGACC AAGAA CCAGG TCAGC CTGAC CTGCC TGGTC
5701 AAAGG CTTCT ATCCC AGCGA CATCG CCGTG GAGTG GGAGA GCAAT GGGCA
5751 GCCGG AGAAC AACTA CAAGA CCACG CCTCC CGTGT TGGAC TCCGA CGGCT
5801 CCTTC TTCCT CTACA GCAAG CTCAC CGTGG ACAAG AGCAG GTGGC AGCAG
5851 GGGAA CGTCT TCTCA TGCTC CGTGA TGCAT GAGGC TCTGC ACAAC CACTA
5901 CACGC AGAAG AGCCT CTCCC TGTCT CCGGG TAAAT GA
```

FVIII 169 protein sequence (SEQ ID NO: 70)

```
   1 MQIELSTCFF LCLLRFCFSA TRRYYLGAVE LSWDYMQSDL GELPVDARFP
  51 PRVPKSFPFN TSVVYKKTLF VEFTDHLFNI AKPRPPWMGL LGPTIQAEVY
 101 DTVVITLKNM ASHPVSLHAV GVSYWKASEG AEYDDQTSQR EKEDDKVFPG
 151 GSHTYVWQVL KENGPMASDP LCLTYSYLSH VDLVKDLNSG LIGALLVCRE
 201 GSLAKEKTQT LHKFILLFAV FDEGKSWHSE TKNSLMQDRD AASARAWPKM
 251 HTVNGYVNRS LPGLIGCHRK SVYWHVIGMG TTPEVHSIFL EGHTFLVRNH
 301 RQASLEISPI TFLTAQTLLM DLGQFLLFCH ISSHQHDGME AYVKVDSCPE
 351 EPQLRMKNNE EAEDYDDDLT DSEMDVVRFD DDNSPSFIQI RSVAKKHPKT
 401 WVHYIAAEEE DWDYAPLVLA PDDRSYKSQY LNNGPQRIGR KYKKVRFMAY
 451 TDETFKTREA IQHESGILGP LLYGEVGDTL LIIFKNQASR PYNIYPHGIT
 501 DVRPLYSRRL PKGVKHLKDF PILPGEIFKY KWTVTVEDGP TKSDPRCLTR
 551 YYSSFVNMER DLASGLIGPL LICYKESVDQ RGNQIMSDKR NVILFSVFDE
 601 NRSWYLIENI QRFLPNPAGV QLEDPEFQAS NIMHSINGYV FDSLQLSVCL
 651 HEVAYWYILS IGAQTDFLSV FFSGYTFKHK MVYEDTLTLF PFSGETVFMS
 701 MENPGLWILG CHNSDFRNRG MTALLKVSSC DKNTGDYYED SYEDISAYLL
 751 SKNNAIEPRS FSQNGAPGTS ESATPESGPG SEPATSGSET PGTSESATPE
 801 SGPGSEPATS GSETPGTSES ATPESGPGTS IEPSEGSAPG SPAGSPTSTE
 851 EGTSESATPE SGPGSEPATS GSETPGTSES ATPESGPGSP AGSPTSTEEG
 901 SPAGSPTSIE EGTSTEPSEG SAPGTSESAT PESGPGTSES ATPESGPGTS
 951 ESATPESGPG SEPATSGSET PGSEPATSGS ETPGSPAGSP TSTEEGTS1E
1001 PSEGSAPGTS IEPSEGSAPG SEPATSGSET PGTSESATPE SGPGTSTEPS
1051 EGSAPASSPP VLKRHQAEIT RTTLQSDQEE IDYDDTISVE MKKEDFDIYD
1101 EDENQSPRSF QKKTRHYFIA AVERLWDYGM SSSPHVLRNR AQSGSVPQFK
1151 KVVFQEFTDG SFTQPLYRGE LNEHLGLLGP YIRAEVEDNI MVTFRNQASR
```

-continued

```
1201  PYSFYSSLIS YEEDQRQGAE PRKNFVKPNE TKTYFWKVQH HMAPTKDEFD
1251  CKAWAYFSDV DLEKDVHSGL IGPLLVCHTN TLNPAHGRQV TVQEFALFFT
1301  IFDETKSWYF TENMERNCRA PCNIQMEDPT FKENYRFHAI NGYIMDTLPG
1351  LVMAQDQRIR WYLLSMGSNE NIHSIHFSGH VFTVRKKEEY KMALYNLYPG
1401  VFETVEMLPS KAGIWRVECL IGEHLHAGMS TLFLVYSNKC QTPLGMASGH
1451  IRDFQITASG QYGQWAPKLA RLHYSGSINA WSTKEPFSWI KVDLLAPMII
1501  HGIKTQGARQ KFSSLYISQF IIMYSLDGKK WQTYRGNSTG TLMVFFGNVD
1551  SSGIKHNIFN PPIIARYIRL HPTHYSIRST LRMELMGCDL NSCSMPLGME
1601  SKAISDAQIT ASSYFTNMFA TWSPSKARLH LQGRSNAWRP QVNNPKEWLQ
1651  VDFQKTMKVT GVTTQGVKSL LTSMYVKEFL ISSSQDGHQW TLFFQNGKVK
1701  VFQGNQDSFT PVVNSLDPPL LTRYLRIHPQ SWVHQIALRM EVLGCEAQDL
1751  YDKTHTCPPC PAPELLGGPS VFLFPPKPKD TLMISRTPEV TCVVVDVSHE
1801  DPEVKFNWYV DGVEVHNAKT KPREEQYNST YRVVSVLTVL HQDWLNGKEY
1851  KCKVSNKALP APIEKTISKA KGQPREPQVY TLPPSRDELT KNQVSLTCLV
1901  KGFYPSDIAV EWESNGQPEN NYKTTPPVLD SDGSFFLYSK LTVDKSRWQQ
1951  GNVFSCSVMH EALHNHYTQK SLSLSPGK*
```

FVIII 263 nucleotide sequence (IHH triple mutant)

(SEQ ID NO: 156)

```
   1  ATGCA AATAG AGCTC TCCAC CTGCT TCTTT CTGTG CCTTT TGCGA TTCTG
  51  CTTTA GTGCC ACCAG AAGAT ACTAC CTGGG TGCAG TGGAA CTGTC ATGGG
 101  ACTAT ATGCA AGGCG CGCCA ACATC AGAGA GCGCC ACCCC TGAAA GTGGT
 151  CCCGG GAGCG AGCCA GCCAC ATCTG GTCGC GAAAC GCCAG GCACA AGTGA
 201  GTCTG CAACT CCCGA GTCCG GACCT GGCTC CGAGC CTGCC ACTAG CGGCT
 251  CCGAG ACTCC GGGAA CTTCC GAGAG CGCTA CACCA GAAAG CGGAC CCGGA
 301  ACCAG TACCG AACCT AGCGA GGGCT CTGCT CCGGG CAGCC CAGCC GGCTC
 351  TCCTA CATCC ACGGA GGAGG GCACT TCCGA ATCCG CCACC CCGGA GTCAG
 401  GGCCA GGATC TGAAC CCGCT ACCTC AGGCA GTGAG ACGCC AGGAA CGAGC
 451  GAGTC CGCTA CACCG AGAGT GGGCA GGGGA GCCCT GCTGA TCTCC CTAC
 501  GTCCA CTGAG GAAGG GTCAC CAGCG GGCTC GCCCA CCAGC ACTGA AGAAG
 551  GTGCC TCGAG CAGTG ATCTC GGTGA GCTGC TGTGT GACGC AAGAT TTCCT
 601  CCTAG AGTGC AAAAA TCTTT TCCAT TCAAC CCTCA GTCGT GTAC AAAAA
 651  GACTC TGTTT GTAGA ATTCA CGGAT CACCT TTTCA ACATC GCTAA GCCAA
 701  GGCCA CCCTG GATGG GTCTG CTAGG TCCTA CCATC CAGGC TGAGG TTTAT
 751  GATAC AGTGG TCATT ACACT TAAGA ACATG GCTTC CCATC CTGTC AGTCT
 801  TCATG CTGTT GGTGT ATCCT ACTGG AAAGC TTCTG AGGGA GCTGA ATATG
 851  ATGAT CAGAC CAGTC AAAGG GAGAA AGAAG ATGAT AAAGT CTTCC CTGGT
 901  GGAAG CCATA CATAT GTCTG GCAGG TCCTG AAAGA GAATG GTCCA ATGGC
 951  CTCTG ACCCA CTGTG CCTTA CCTAC TCATA TCTTT CTCAT GTGGA CCTGG
1001  TAAAA GACTT GAATT CAGGC CTCAT GGAGC CCTA CTAGT ATGTA GAGAA
1051  GGGAG TCTGG CCAAG GAAAA GACAC AGACC TTGCA CAAAT TTATA CTACT
```

-continued

```
1101  TTTTG CTGTA TTTGA TGAAG GGAAA AGTTG GCACT CAGAA ACAAA GAACT
1151  CCTTG ATGCA GGATA GGGAT GCTGC ATCTG CTCGG GCCTG GCCTA AATG
1201  CACAC AGTCA ATGGT TATGT AAACA GGTCT CTGCC AGGTC TGATT GGATG
1251  CCACA GGAAA TCAGT CTATT GGCAT GTGAT TGGAA TGGGC ACCAC TCCTG
1301  AAGTG CACTC AATAT CCTC GAAGG TCACA CATTT CTTGT GAGGA ACCAT
1351  CGCCA GGCTA GCTTG GAAAT CTCGC CAATA ACTTT CCTTA CTGCT CAAAC
1401  ACTCT TGATG GACCT TGGAC AGTTT CTACT GTTTT GTCAT ATCTC TTCCC
1451  ACCAA CATGA TGGCA TGGAA GCTTA TGTCA AAGTA GACAG CTGTC CAGAG
1501  GAACC CCAAC TACGA ATGAA AAATA ATGAA GAAGC GGAAG ACTAT GATGA
1551  TGATC TTACT GATTC TGAAA TGGAT GTGGT CAGGT TTGAT GATGA CAACT
1601  CTCCT TCCTT TATCC AAATT CGCTC AGTTG CCAAG AAGCA TCCTA AAACT
1651  TGGGT ACATT ACATT GCTGC TGAAG AGGAG GACTG GGACT ATGCT CCCTT
1701  AGTCC TCGCC CCGA TGACA GAAGT TATAA AAGTC AATAT TTGAA CAATG
1751  GCCCT CAGCG GATTG GTAGG AAGTA CAAAA AAGTC CGATT TATGG CATAC
1801  ACAGA TGAAA CCTTT AAGAC TCGTG AAGCT ATTCA GCATG AATCA GGAAT
1851  CTTGG GACCT TTACT TTATG GGGAA GTTGG AGACA CACTG TTGAT TATAT
1901  TTAAG AATCA AGCAA GCAGA CCATA TAACA TCTAC CCTCA CGGAA TCACT
1951  GATGT CCGTC CTTTG TATTC AAGGA GATTA CCAAA AGGTG TAAAA CATTT
2001  GAAGG ATTTT CCAAT TCTGC CAGGA GAAAT ATTCA AATAT AAATG GACAG
2051  TGACT GTAGA AGATG GCCAA CTAAA ATCAG ATCCT CGGTG CCTGA CCCGC
2101  TATTA CTCTA GTTTC GTTAA TATGG AGAGA GATCT AGCTT CAGGA CTCAT
2151  TGGCC CTCTC CTCAT CTGCT ACAAA GAATC TGTAG ATCAA AGAGG AAACC
2201  AGATA ATGTC AGACA AGAGG AATGT CATCC TGTTT TCTGT ATTTG ATGAG
2251  AACCG AAGCT GGTAC CTCAC AGAGA ATATA CAACG CTTTC TCCCC AATCC
2301  AGCTG GAGTG CAGCT TGAGG ATCCA GAGTT CCAAG CCTCC AACAT CATGC
2351  ACAGC ATCAA TGGCT ATGTT TTTGA TAGTT TGCAG TTGTC AGTTT GTTTG
2401  CATGA GGTGG CATAC TGGTA CATTC TAAGC ATTGG AGCAC AGACT GACTT
2451  CCTTT CTGTC TTCTT CTCTG GATAT ACCTT CAAAC ACAAA ATGGT CTATG
2501  AAGAC ACACT CACCC TATTC CCATT CTCAG GAGAA ACTGT CTTCA TGTCG
2551  ATGGA AAACC CAGGT CTATG GATTC TGGGG TGCCA CAACT CAGAC TTTCG
2601  GAACA GAGGC ATGAC CGCCT TACTG AAGGT TTCTA GTTGT GACAA GAACA
2651  CTGGT GATTA TTACG AGGAC AGTTA TGAAG ATATT TCAGC ATACT TGCTG
2701  AGTAA AAACA ATGCC ATTGA ACCAA GAAGC TTCTC TCAAA ACGGC GCGCC
2751  AGGTA CCTCA GAGTC TGCTA CCCCC GAGTC AGGGC AGGA TCAGA GCCAG
2801  CCACC TCCGG GTCTG AGACA CCCGG GACTT CCGAG AGTGC ACCCC TGAG
2851  TCCGG ACCCG GTCC GAGCC CGCCA CTTCC GGCTC CGAAA CTCCC GGCAC
2901  AAGCG AGAGC GCTAC CCCAG AGTCA GGACC AGGAA CATCT ACAGA GCCCT
2951  CTGAA GGCTC CGCTC CAGGG TCCCC AGCCG GCAGT CCCAC TAGCA CCGAG
3001  GAGGG AACCT CTGAA AGCGC ACACC CCGAA TCAGG GCCAG GGTCT GAGCC
3051  TGCTA CCAGC GGCAG CGAGA CACCA GGCAC CTCTG AGTCC GCCAC ACCAG
```

```
3101 AGTCC GGACC CGGAT CTCCC GCTGG GAGCC CCACC TCCAC TGAGG AGGGA
3151 TCTCC TGCTG GCTCT CCAAC ATCTA CTGAG GAAGG TACCT CAACC GAGCC
3201 ATCCG AGGGA TCAGC TCCCG GCACC TCAGA GTCGG CAACC CCGGA GTCTG
3251 GACCC GGAAC TTCCG AAAGT GCCAC ACCAG AGTCG GGTCC CGGGA CTTCA
3301 GAATC AGCAA CACCC GAGTC CGGCC CTGGG TCTGA ACCCG CCACA GTGGG
3351 TAGTG AGACA CCAGG ATCAG AACCT GCTAC CTCAG GGTCA GAGAC ACCCG
3401 GATCT CCGGC AGGCT CACCA ACCTC CACTG AGGAG GGCAC AGCA CAGAA
3451 CCAAG CGAGG GCTCC GCACC CGGAA CAAGC ACTGA ACCCA GTGAG GGTTC
3501 AGCAC CCGGC TCTGA GCCGG CCACA GTGGC AGTG AGACA CCCGG CACTT
3551 CAGAG AGTGC CACCC CCGAG AGTGG CCCAG GCACT AGTAC CGAGC CCTCT
3601 GAAGG CAGTG CGCCA GCCTC GAGCC CACCA GTCTT GAAAC GCCAT CAAGC
3651 TGAAA TAACT CGTAC TACTC TTCAG TCAGA TCAAG AGGAA ATCGA TTATG
3701 ATGAT ACCAT ATCAG TTGAA ATGAA GAAGG AAGAT TTTGA CATTT ATGAT
3751 GAGGA TGAAA ATCAG AGCCC CCGCA GCTTT CAAAA GAAAA CACGA CACTA
3801 TTTTA TTGCT GCAGT GGAGA GGCTC TGGGA TTATG GGATG AGTAG CTCCC
3851 CACAT GTTCT AAGAA ACAGG GCTCA GAGTG GCAGT GTCCC TCAGT TCAAG
3901 AAAGT TGTTT CCAG GAATT TACTG ATGGC TCCTT TACTC AGCCC TTATA
3951 CCGTG GAGAA CTAAA TGAAC ATTTG GGACT CCTGG GGCCA TATAT AAGAG
4001 CAGAA GTTGA AGATA ATATC ATGGT AACTT TCAGA AATCA GGCCT CTCGT
4051 CCCTA TTCCT TCTAT TCTAG CCTTA TTTCT TATGA GGAAG ATCAG AGGCA
4101 AGGAG CAGAA CCTAG AAAAA ACTTT GTCAA GCCTA ATGAA ACCAA AACTT
4151 ACTTT TGGAA AGTGC AACAT CATAT GGCAC CCACT AAAGA TGAGT TTGAC
4201 TGCAA AGCCT GGGCT TATTT CTCTG ATGTT GACCT GGAAA AAGAT GTGCA
4251 CTCAG GCCTG ATTGG ACCCC TTCTG GTCTG CCACA CTAAC ACACT GAACC
4301 CTGCT CATGG GAGAC AAGTG ACAGT ACAGG AATTT GCTCT GTTTT TCACC
4351 ATCTT TGATG AGACC AAAAG CTGGT ACTTC ACTGA AAATA TGGAA AGAAA
4401 CTGCA GGGCT CCCTG CAATA TCCAG ATGGA AGATC CCACT TTTAA AGAGA
4451 ATTAT CGCTT CCATG CAATC AATGG CTACA TAATG GATAC ACTAC CTGGC
4501 TTAGT AATGG CTCAG GATCA AAGGA TTCGA TGGTA TCTGC TCAGC ATGGG
4551 CAGCA ATGAA AACAT CCATT CTATT CATTT CAGTG GACAT GTGTT CACTG
4601 TACGA AAAAA AGAGG AGTAT AAAAT GGCAC TGTAC AATCT CTATC CAGGT
4651 GTTTT TGAGA CAGTG GAAAT GTTAC CATCC AAAGC TGGAA TTTGG CGGGT
4701 GGAAT GCCTT ATTGG CGAGC ATCTA CATGC TGGGA TGAGC ACACT TTTTC
4751 TGGTG TACAG CAATA AGTGT CAGAC TCCCC TGGGA ATGGC TTCTG GACAC
4801 ATTAG AGATT TTCAG ATTAC AGCTT CAGGA CAATA TGGAC AGTGG GCCCC
4851 AAAGC TGGCC AGACT TCATT ATTCC GGATC AATCA ATGCC TGGAG CACCA
4901 AGGAG CCCTT TTCTT GGATC AAGGT GGATC TGTTG CACC AATGA TTATT
4951 CACGG CATCA AGACC CAGGG TGCCC GTCAG AAGTT CTCCA GCCTC TACAT
5001 CTCTC AGTTT ATCAT CATGT ATAGT CTTGA TGGGA AGAAG TGGCA GACTT
```

```
5051  ATCGA GGAAA TTCCA CTGGA ACCTT AATGG TCTTC TTTGG CAATG TGGAT
5101  TCATC TGGGA TAAAA CACAA TATTT TTAAC CCTCC AATTA TTGCT CGATA
5151  CATCC GTTTG CACCC AACTC ATTAT AGCAT TCGCA GCACT CTTCG CATGG
5201  AGTTG ATGGG CTGTG ATTTA AATAG TTGCA GCATG CCATT GGGAA TGGAG
5251  AGTAA AGCAA TATCA GATGC ACAGA TTACT GCTTC ATCCT ACTTT ACCAA
5301  TATGT TTGCC ACCTG GTCTC CTTCA AAAGC TCGAC TTCAC CTCCA AGGGA
5351  GGAGT AATGC CTGGA GACCT CAGGT GAATA ATCCA AAAGA GTGGC TGCAA
5401  GTGGA CTTCC AGAAG ACAAT GAAAG TCACA GGAGT AACTA CTCAG GGAGT
5451  AAAAT CTCTG CTTAC AGCA TGTAT GTGAA GGAGT CCTC ATCTC CAGCA
5501  GTCAA GATGG CCATC AGTGG ACTCT CTTTT TTCAG AATGG CAAAG TAAAG
5551  GTTTT TCAGG GAAAT CAAGA CTCCT TCACA CCTGT GGTGA ACTCT CTAGA
5601  CCCAC CGTTA CTGAC TCGCT ACCTT CGAAT TCACC CCCAG AGTTG GGTGC
5651  ACCAG ATTGC CCTGA GGATG GAGGT TCTGG GCTGC GAGGC ACAGG ACCTC
5701  TACGA CAAAA CTCAC ACATG CCCAC CGTGC CCAGC TCCAG AACTC CTGGG
5751  CGGAC CGTCA GTCTT CCTCT TCCCC CCAAA ACCCA AGGAC ACCCT CATGG
5801  CCTCC CGGAC CCCTG AGGTC ACATG CGTGG TGGTG GACGT GAGCC ACGAA
5851  GACCC TGAGG TCAAG TTCAA CTGGT ACGTG GACGG CGTGG AGGTG CATAA
5901  TGCCA AGACA AAGCC GCGGG AGGAG CAGTA CAACA GCACG TACCG TGTGG
5951  TCAGC GTCCT CACCG TCCTG GCCCA GGACT GGCTG AATGG CAAGG AGTAC
6001  AAGTG CAAGG TCTCC AACAA AGCCC TCCCA GCCCC CATCG AGAAA ACCAT
6051  CTCCA AAGCC AAAGG GCAGC CCCGA GAACC ACAGG TGTAC ACCCT GCCCC
6101  CATCC CGCGA TGAGC TGACC AAGAA CCAGG TCAGC CTGAC CTGCC TGGTC
6151  AAAGG CTTCT ATCCC AGCGA CATCG CCGTG GAGTG GGAGA GCAAT GGGCA
6201  GCCGG AGAAC AACTA CAAGA CCACG CCTCC CGTGT TGGAC TCCGA CGGCT
6251  CCTTC TTCCT CTACA GCAAG CTCAC CGTGG ACAAG AGCAG GTGGC AGCAG
6301  GGGAA CGTCT TCTCA TGCTC CGTGA TGCAT GAGGC TCTGC ACAAC GCCTA
6351  CACGC AGAAG AGCCT CTCCC TGTCT CCGGG TAAAT GA
```

FVIII 263 protein sequence(IHH triple mutant)
(SEQ ID NO: 157)

```
  1 MQIELSTCFF LCLLRFCFSA TRRYYLGAVE LSWDYMQGAP TSESATPESG
 51 PGSEPATSGS ETPGTSESAT PESGPGSEPA TSGSETPGTS ESATPESGPG
101 TSIEPSEGSA PGSPAGSPTS TEEGTSESAT PESGPGSEPA TSGSETPGTS
151 ESATPESGPG SPAGSPTSTE EGSPAGSPTS lEEGASSSDL GELPVDARFP
201 PRVPKSFPFN TSVVYKKTLF VEFTDHLFNI AKPRPPWMGL LGPTIQAEVY
251 DTVVITLKNM ASHPVSLHAV GVSYWKASEG AEYDDQTSQR EKEDDKVFPG
301 GSHTYVWQVL KENGPMASDP LCLTYSYLSH VDLVKDLNSG LIGALLVCRE
351 GSLAKEKTQT LHKFILLFAV FDEGKSWHSE TKNSLMQDRD AASARAWPKM
401 HTVNGYVNRS LPGLIGCHRK SVYWHVIGMG TTPEVHSIFL EGHTFLVRNH
451 RQASLEISPI TFLTAQTLLM DLGQFLLFCH ISSHQHDGME AYVKVDSCPE
501 EPQLRMKNNE EAEDYDDDLT DSEMDVVRFD DDNPSFIQI RSVAKKHPKT
551 WVHYIAAEEE DWDYAPLVLA PDDRSYKSQY LNNGPQRIGR KYKKVRFMAY
```

```
 601 TDETFKTREA IQHESGILGP LLYGEVGDTL LIIFKNQASR PYNIYPHGIT

651 DVRPLYSRRL PKGVKHLKDF PILPGEIFKY KWTVTVEDGP TKSDPRCLTR

701 YYSSFVNMER DLASGLIGPL LICYKESVDQ RGNQIMSDKR NVILFSVFDE

751 NRSWYL1ENI QRFLPNPAGV QLEDPEFQAS NIMHSINGYV FDSLQLSVCL

801 HEVAYWYILS IGAQTDFLSV FFSGYTFKHK MVYEDTLTLF PFSGETVFMS

851 MENPGLWILG CHNSDFRNRG MTALLKVSSC DKNTGDYYED SYEDISAYLL

901 SKNNAIEPRS FSQNGAPGTS ESATPESGPG SEPATSGSET PGTSESATPE

951 SGPGSEPATS GSETPGTSES ATPESGPGTS TEPSEGSAPG SPAGSPTSTE

1001 EGTSESATPE SGPGSEPATS GSETPGTSES ATPESGPGSP AGSPTS1LEG

1051 SPAGSPTSTE EGTSTEPSEG SAPGTSESAT PESGPGTSES ATPESGPGTS

1101 ESATPESGPG SEPATSGSET PGSEPATSGS ETPGSPAGSP TSTEEGTSTE

1151 PSEGSAPGTS TEPSEGSAPG SEPATSGSET PGTSESATPE SGPGTSTEPS

1201 EGSAPASSPP VLKRHQAEIT RTTLQSDQEE IDYDDTISVE MKKEDFDIYD

1251 EDENQSPRSF QKKTRHYFIA AVERLWDYGM SSSPHVLRNR AQSGSVPQFK

1301 KVVFQEFTDG SFTQPLYRGE LNEHLGLLGP YIRAEVEDNI MVTFRNQASR

1351 PYSFYSSLIS YEEDQRQGAE PRKNFVKPNE TKTYFWKVQH HMAPTKDEFD

1401 CKAWAYFSDV DLEKDVHSGL IGPLLVCHTN TLNPAHGRQV TVQEFALFFT

1451 IFDETKSWYF TENMERNCRA PCNIQMEDPT FKENYRFHAI NGYIMDTLPG

1501 LVMAQDQRIR WYLLSMGSNE NIHSIHFSGH VFTVRKKEEY KMALYNLYPG

1551 VFETVEMLPS KAGIWRVECL IGEHLHAGMS TLFLVYSNKC QTPLGMASGH

1601 IRDFQITASG QYGQWAPKLA RLHYSGSINA WSTKEPFSWI KVDLLAPMII

1651 HGIKTQGARQ KFSSLYISQF IIMYSLDGKK WQTYRGNSTG TLMVFFGNVD

1701 SSGIKHNIFN PPIIARYIRL HPTHYSIRST LRMELMGCDL NSCSMPLGME

1751 SKAISDAQIT ASSYFTNMFA TWSPSKARLH LQGRSNAWRP QVNNPKEWLQ

1801 VDFQKTMKVT GVTTQGVKSL LTSMYVKEFL ISSSQDGHQW TLFFQNGKVK

1851 VFQGNQDSFT PVVNSLDPPL LTRYLRIHPQ SWVHQIALRM EVLGCEAQDL

1901 YDKTHTCPPC PAPELLGGPS VFLFPPKPKD TLMASRTPEV TCVVVDVSHE

1951 DPEVKFNWYV DGVEVHNAKT KPREEQYNST YRVVSVLTVL AQDWLNGKEY

2001 KCKVSNKALP APIEKTISKA KGQPREPQVY TLPPSRDELT KNQVSLTCLV

2051 KGFYPSDIAV EWESNGQPEN NYKTTPPVLD SDGSFFLYSK LTVDKSRWQQ

2101 GNVFSCSVMH EALHNAYTQK SLSLSPGK*
```

FVIII 282 nucleotide sequence (SEQ ID NO: 158)

```
   1 ATGCA AATAG AGCTC TCCAC CTGCT TCTTT CTGTG CCTTT TGCGA TTCTG

51 CTTTA GTGCC ACCAG AAGAT ACTAC CTGGG TGCAG TGGAA CTGTC ATGGG

101 ACTAT ATGCA AAGTG ATCTC GGTGA GCTGC CTGTG GACGC AAGAT TTCCT

151 CCTAG AGTGC CAAAA TCTTT TCCAT TCAAC ACCTC AGTCG TGTAC AAAAA

201 GACTC TGTTT GTAGA ATTCA CGGAT CACCT TTTCA ACATC GCTAA GCCAA

251 GGCCA CCCTG GATGG GTCTG CTAGG TCCTA CCATC CAGGC TGAGG TTTAT

301 GATAC AGTGG TCATT ACACT TAAGA ACATG GCTTC CCATC CTGTC AGTCT
```

```
 351  TCATG CTGTT GGTGT ATCCT ACTGG AAAGC TTCTG AGGGA GCTGA ATATG

401  ATGAT CAGAC CAGTC AAAGG GAGAA AGAAG ATGAT AAAGT CTTCC CTGGT

451  GGAAG CCATA CATAT GTCTG GCAGG TCCTG AAAGA GAATG GTCCA ATGGC

501  CTCTG ACCCA CTGTG CCTTA CCTAC TCATA TCTTT CTCAT GTGGA CCTGG

551  TAAAA GACTT GAATT CAGGC TCATG GGAGC CCTA CTAGT ATGTA GAGAA

601  GGGAG TCTGG CCAAG GAAAA GACAC AGACC TTGCA CAAAT TTATA CTACT

651  TTTTG CTGTA TTTGA TGAAG GGAAA AGTTG GCACT CAGAA ACAAA GAACT

701  CCTTG ATGCA GGATA GGGAT GCTGC ATCTG CTCGG GCCTG GCCTA AAATG

751  CACAC AGTCA ATGGT TATGT AAACA GGTCT CTGCC AGGTC TGATT GGATG

801  CCACA GGAAA TCAGT CTATT GGCAT GTGAT TGGAA TGGGC ACCAC TCCTG

851  AAGTG CACTC AATAT CCTC GAAGG TCACA CATTT CTTGT GAGGA ACCAT

901  CGCCA GGCTA GCTTG GAAAT CTCGC CAATA ACTTT CCTTA CTGCT CAAAC

951  ACTCT TGATG GACCT GGAC AGTTT CTACT GTTTT GTCAT ATCTC TTCCC

1001  ACCAA CATGA TGGCA TGGAA GCTTA TGTCA AAGTA GACAG CTGTC CAGAG

1051  GAACC CCAAC TACGA ATGAA AAATA ATGAA GAAGC GGAAG ACTAT GATGA

1101  TGATC TTACT GATTC TGAAA TGGAT GTGGT CAGGT TTGAT GATGA CAACT

1151  CTCCT TCCTT TATCC AAATT CGCTC AGTTG CCAAG AAGCA TCCTA AAACT

1201  TGGGT ACATT ACATT GCTGC TGAAG AGGAG GACTG GGACT ATGCT CCCTT

1251  AGTCC TCGCC CCCGA TGACA GAAGT TATAA AGTC AATAT TTGAA CAATG

1301  GCCCT CAGCG GATTG GTAGG AAGTA CAAAA AGTC CGATT TATGG CATAC

1351  ACAGA TGAAA CCTTT AAGAC TCGTG AAGCT ATTCA GCATG AATCA GGAAT

1401  CTTGG GACCT TTACT TTATG GGAA GTTGG AGACA CACTG TTGAT TATAT

1451  TTAAG AATCA AGCAA GCAGA CCATA TAACA TCTAC CCTCA CGGAA TCACT

1501  GATGT CCGTC CTTTG TATTC AAGGA GATTA CCAAA AGGTG TAAAA CATTT

1551  GAAGG ATTTT CCAAT CTGC AGGA GAAAT ATTCA AATAT AAATG GACAG

1601  TGACT GTAGA AGATG GCCA ACTAA ATCAG ATCCT CGGTG CCTGA CCCGC

1651  TATTA CTCTA GTTTC GTTAA TATGG AGAGA GATC AGCTT CAGGA CTCAT

1701  TGGCC CTCTC CTCAT CTGCT ACAAA GAATC TGTAG ATCAA AGAGG AAACC

1751  AGATA ATGTC AGACA GAGG AATGT CATCC TGTTT TCTGT ATTTG ATGAG

1801  AACCG AAGCT GGTAC CTCAC AGAGA ATATA CAACG CTTTC TCCCC AATCC

1851  AGCTG GAGTG CAGCT TGAGG ATCCA GAGTT CCAAG CCTCC AACAT CATGC

1901  ACAGC ATCAA TGGCT ATGTT TTTGA TAGTT TGCAG TTGTC AGTTT GTTTG

1951  CATGA GGTGG CATAC TGGTA CATTC TAAGC ATTGG AGCAC AGACT GACTT

2001  CCTTT CTGTC TTCTT CTCTG GATAT ACCTT CAAAC ACAAA ATGGT CTATG

2051  AAGAC ACACT CACCC TATTC CCATT CTCAG GAGAA ACTGT CTTCA TGTCG

2101  ATGGA AAACC CAGGT CTATG GATTC TGGGG TGCCA CAACT CAGAC TTTCG

2151  GAACA GAGGC ATGAC CGCCT TACTG AAGGT TCTA GTTGT GACAA GAACA

2201  CTGGT GATTA TTACG AGGAC AGTTA TGAAG ATATT TCAGC ATACT GCTGG

2251  AGTAA AAACA ATGCC ATTGA ACCAA GAAGC TTCTC TCAAA ACGGC GCGCC

2301  AACAT CAGAG AGCGC CACCC CTGAA AGTGG TCCCG GGAGC GAGCC AGCCA
```

```
2351 CATCT GGGTC GGAAA CGCCA GGCAC AAGTG AGTCT GCAAC TCCCG AGTCC

2401 GGACC TGGCT CCGAG CCTGC CACTA GCGGC TCCGA GACTC CGGGA ACTTC

2451 CGAGA GCGCT ACACC AGAAA GCGGA CCCGG AACCA GTACC GAACC TAGCG

2501 AGGGC TCTGC TCCGG GCAGC CCAGC CGGCT CTCCT ACATC CACGG AGGAG

2551 GGCAC TTCCG AATCC GCCAC CCCGG AGTCA GGGCC AGGAT CTGAA CCCGC

2601 TACCT CAGGC AGTGA GACGC AGGA ACGAG CGAGT CCGCT ACACC GGAGA

2651 GTGGG CCAGG GAGCC TGCT GGATC TCCTA CGTCC ACTGA GGAAG GGTCA

2701 CCAGC GGGCT CGCCC ACCAG CACTG AAGAA GGTGC CTCGA GCCCA CCAGT

2751 CTTGA AACGC CATCA AGCTG AAATA ACTCG TACTA CTCTT CAGTC AGATC

2801 AAGAG GAAAT CGATT ATGAT GATAC CATAT CAGTT GAAAT GAAGA AGGAA

2851 GATTT TGACA TTTAT GATGA GGATG AAAAT CAGAG CCCCC GCAGC TTTCA

2901 AAAGA AAACA CGACA CTATT TTATT GCTGC AGTGG AGAGG CTCTG GGATT

2951 ATGGG ATGAG TAGCT CCCCA CATGT TCTAA GAAAC AGGGC TCAGA GTGGC

3001 AGTGT CCCTC AGTTC AAGAA AGTTG TTTTC CAGGA ATTTA CTGAT GGCTC

3051 CTTTA CTCAG CCCTT ATACC GTGGA GAACT AAATG AACAT TGGGA CTCC

3101 TGGGG CCATA TATAA GAGCA GAAGT TGAAG ATAAT ATCAT GGTAA CTTTC

3151 AGAAA TCAGG CCTCT CGTCC CTATT CCTTC TATTC TAGCC TTATT TCTTA

3201 TGAGG AAGAT CAGAG GCAAG GAGCA GAACC TAGAA AAAAC TTTGT CAAGC

3251 CTAAT GAAAC CAAAA CTTAC TTTTG GAAAG TGCAA CATCA TATGG CACCC

3301 ACTAA AGATG AGTTT GACTG CAAAG CCTGG GCTTA TTTCT CTGAT GTTGA

3351 CCTGG AAAAA GATGT GCACT CAGGC CTGAT GGACC CCTT CTGGT CTGCC

3401 ACACT AACAC ACTGA ACCCT GCTCA TGGGA GACAA GTGAC AGTAC AGGAA

3451 TTTGC TCTGT TTTTC ACCAT CTTTG ATGAG ACCAA AAGCT GGTAC TTCAC

3501 TGAAA ATATG GAAAG AAACT GCAGG GCTCC CTGCA ATATC CAGAT GGAAG

3551 ATCCC ACTTT TAAAG AGAAT TATCG CTTCC ATGCA ATCAA TGGCT ACATA

3601 ATGGA TACAC TACCT GGCTT AGTAA TGGCT CAGGA TCAAA GGATT CGATG

3651 GTATC TGCTC AGCAT GGGCA GCAAT GAAAA CATCC ATTCT ATTCA TTTCA

3701 GTGGA CATGT GTTCA CTGTA CGAAA AAAAG AGGAG TATAA AATGG CACTG

3751 TACAA TCTCT ATCCA GGTGT TTTTG AGACA GTGGA AATGT TACCA TCCAA

3801 AGCTG GAATT TGGCG GGTGG AATGC CTTAT GGCCG AGCAT CTACA TGCTG

3851 GGATG AGCAC ACTTT TTCTG GTGTA CAGCA ATAAG TGTCA GACTC CCCTG

3901 GGAAT GGCTT CTGGA CACAT TAGAG ATTTT CAGAT TACAG CTTCA GGACA

3951 ATATG GACAG TGGGC CCCAA AGCTG CCAG ACTTC ATTAT CCGGA TCAA

4001 TCAAT GCCTG GAGCA CCAAG GAGCC CTTTT CTTGG ATCAA GGTGG ATCTG

4051 TTGGC ACCAA TGATT ATTCA CGGCA TCAAG ACCCA GGGTG CCCGT CAGAA

4101 GTTCT CCAGC CTCTA CATCT CTCAG TTTAT CATCA TGTAT AGTCT TGATG

4151 GGAAG AAGTG GCAGA CTTAT CGAGG AAATT CCACT GGAAC CTTAA TGGTC

4201 TTCTT TGGCA ATGTG GATTC ATCTG GGATA AAACA CAATA TTTTT AACCC

4251 TCCAA TTATT GCTCG ATACA TCCGT TTGCA CCCAA CTCAT TATAG CATTC
```

-continued

```
4301 GCAGC ACTCT TCGCA TGGAG TTGAT GGGCT GTGAT TTAAA TAGTT GCAGC

4351 ATGCC ATTGG GAATG AGAGG TAAAG CAATA TCAGA TGCAC AGATT ACTGC

4401 TTCAT CCTAC TTTAC CAATA TGTTT GCCAC CTGGT CTCCT TCAAA GCTC

4451 GACTT CACCT CCAAG GGAGG AGTAA TGCCT GGAGA CCTCA GGTGA ATAAT

4501 CCAAA AGAGT GGCTG CAAGT GGACT TCCAG AAGAC AATGA AAGTC ACAGG

4551 AGTAA CTACT CAGGG AGTAA AATCT CTGCT TACCA GCATG TATGT GAAGG

4601 AGTTC CTCAT CTCCA GCAGT CAAGA TGGCC ATCAG TGGAC TCTCT TTTTT

4651 CAGAA TGGCA AAGTA AAGGT TTTTC AGGGA AATCA AGACT CCTTA CACCC

4701 TGTGG TGAAC TCTCT AGACC CACCG TTACT GACTC GCTAC CTTCG AATTC

4751 ACCCC CAGAG TTGGG TGCAC AGAT TGCCC TGAGG ATGGA GGTTC TGGGC

4801 TGCGA GGCAC AGGAC CTCTA CGACA AAACT CACAC ATGCC CACCG TGCCC

4851 AGCTC CAGAA CTCCT GGGCG GACCG TCAGT CTTCC TCTTC CCCCC AAAAC

4901 CCAAG GACAC CCTCA TGATC TCCCG GACCC CTGAG GTCAC ATGCG TGGTG

4951 GTGGA CGTGA GCCAC GAAGA CCCTG AGGTC AAGTT CAACT GGTAC GTGGA

5001 CGGCG TGGAG GTGCA TAATG CCAAG ACAAA GCCGC GGGAG GAGCA GTACA

5051 ACAGC ACGTA CCGTG TGGTC AGCGT CCTCA CCGTC CTGCA CCAGG ACTGG

5101 CTGAA TGGCA AGGAG TACAA GTGCA AGGTC TCCAA CAAAG CCCTC CCAGC

5151 CCCCA TCGAG AAAAC CATCT CCAAA GCCAA AGGGC AGCCC CGAGA ACCAC

5201 AGGTG TACAC CCTGC CCCCA TCCCG GGATG AGCTG ACCAA GAACC AGGTC

5251 AGCCT GACCT GCCTG GTCAA AGGCT TCTAT CCCAG CGACA TCGCC GTGGA

5301 GTGGG AGAGC AATGG GCAGC CGGAG AACAA CTACA AGACC ACGCC TCCCG

5351 TGTTG GACTC CGACG GCTCC TTCTT CCTCT ACAGC AAGCT CACCG TGGAC

5401 AAGAG CAGGT GGCAG CAGGG GAACG TCTTC TCATG CTCCG TGATG CATGA

5451 GGCTC TGCAC AACCA CTACA CGCAG AAGAG CCTCT CCCTG TCTCC GGGTA

5501 AATGA
```

FVIII 282 protein sequence (SEQ ID NO: 159)

```
  1 MQIELSTCFF LCLLRFCFSA TRRYYLGAVE LSWDYMQSDL GELPVDARFP

51 PRVPKSFPFN TSVVYKKTLF VEFTDHLFNI AKPRPPWMGL LGPTIQAEVY

101 DTVVITLKNM ASHPVSLHAV GVSYWKASEG AEYDDQTSQR EKEDDKVFPG

151 GSHTYVWQVL KENGPMASDP LCLTYSYLSH VDLVKDLNSG LIGALLVCRE

201 GSLAKEKTQT LHKFILLFAV FDEGKSWHSE TKNSLMQDRD AASARAWPKM

251 HTVNGYVNRS LPGLIGCHRK SVYWHVIGMG TTPEVHSIFL EGHTFLVRNH

301 RQASLEISPI TFLTAQTLLM DLGQFLLFCH ISSHQHDGME AYVKVDSCPE

351 EPQLRMKNNE EAEDYDDDLT DSEMDVVRFD DDNSPSFIQI RSVAKKHPKT

401 WVHYIAAEEE DWDYAPLVLA PDDRSYKSQY LNNGPQRIGR KYKKVRFMAY

451 TDETFKTREA IQHESGILGP LLYGEVGDTL LIIFKNQASR PYNIYPHGIT

501 DVRPLYSRRL PKGVKHLKDF PILPGEIFKY KWTVTVEDGP TKSDPRCLTR

551 YYSSFVNMER DLASGLIGPL LICYKESVDQ RGNQIMSDKR NVILFSVFDE

601 NRSWYL1ENI QRFLPNPAGV QLEDPEFQAS NIMHSINGYV FDSLQLSVCL

651 HEVAYWYILS IGAQTDFLSV FFSGYTFKHK MVYEDTLTLF PFSGETVFMS
```

```
 701 MENPGLWILG CHNSDFRNRG MTALLKVSSC DKNTGDYYED SYEDISAYLL

751 SKNNAIEPRS FSQNGAPTSE SATPESGPGS EPATSGSETP GTSESATPES

801 GPGSEPATSG SETPGTSESA TPESGPGTST EPSEGSAPGS PAGSPTSTEE

851 GTSESATPES GPGSEPATSG SETPGTSESA TPESGPGSPA GSPTSTEEGS

901 PAGSPTSTEE GASSPPVLKR HQAEITRTTL QSDQEEIDYD DTISVEMKKE

951 DFDIYDEDEN QSPRSFQKKT RHYFIAAVER LWDYGMSSSP HVLRNRAQSG

1001 SVPQFKKVVF QEFTDGSFTQ PLYRGELNEH LGLLGPYIRA EVEDNIMVTF

1051 RNQASRPYSF YSSLISYEED QRQGAEPRKN FVKPNETKTY FWKVQHHMAP

1101 TKDEFDCKAW AYFSDVDLEK DVHSGLIGPL LVCHTNTLNP AHGRQVTVQE

1151 FALFFTIFDE TKSWYFTENM ERNCRAPCNI QMEDPTFKEN YRFHAINGYI

1201 MDTLPGLVMA QDQRIRWYLL SMGSNENIHS IHFSGHVFTV RKKEEYKMAL

1251 YNLYPGVFET VEMLPSKAGI WRVECLIGEH LHAGMSTLFL VYSNKCQTPL

1301 GMASGHIRDF QITASGQYGQ WAPKLARLHY SGSINAWSTK EPFSWIKVDL

1351 LAPMIIHGIK TQGARQKFSS LYISQFIIMY SLDGKKWQTY RGNSTGTLMV

1401 FFGNVDSSGI KHNIFNPPII ARYIRLHPTH YSIRSTLRME LMGCDLNSCS

1451 MPLGMESKAI SDAQITASSY FTNMFATWSP SKARLHLQGR SNAWRPQVNN

1501 PKEWLQVDFQ KTMKVTGVTT QGVKSLLTSM YVKEFLISSS QDGHQWTLFF

1551 QNGKVKVFQG NQDSFTPVVN SLDPPLLTRY LRIHPQSWVH QIALRMEVLG

1601 CEAQDLYDKT HTCPPCPAPE LLGGPSVFLF PPKPKDTLMI SRTPEVTCVV

1651 VDVSHEDPEV KFNWYVDGVE VHNAKTKPRE EQYNSTYRVV SVLTVLHQDW

1701 LNGKEYKCKV SNKALPAPIE KTISKAKGQP REPQVYTLPP SRDELTKNQV

1751 SLTCLVKGFY PSDIAVEWES NGQPENNYKT TPPVLDSDGS FFLYSKLTVD

1801 KSRWQQGNVF SCSVMHEALH NHYTQKSLSL SPGK*
```

FVIII 283 nucleotide sequence (FVIII 169 with IHH triple mutation)
(SEQ ID NO: 160)

```
   1 ATGCA AATAG AGCTC TCCAC CTGCT TCTTT CTGTG CCTTT TGCGA TTCTG

51 CTTTA GTGCC ACCAG AAGAT ACTAC CTGGG TGCAG TGGAA CTGTC ATGGG

101 ACTAT ATGCA AAGTG ATCTC GGTGA GCTGC TGTGT GACGC AAGAT TTCCT

151 CCTAG AGTGC CAAAA TCTTT TCCAT TCAAC ACCTC AGTCG TGTAC AAAAA

201 GACTC TGTTT GTAGA ATTCA CGGAT CACCT TTTCA ACATC GCTAA GCCAA

251 GGCCA CCCTG GATGG GTCTG CTAGG TCCTA CCATC AGGC TGAGG TTTAT

301 GATAC AGTGG TCATT ACACT TAAGA ACATG GCTTC CCATC CTGTC AGTCT

351 TCATG CTGTT GGTGT ATCCT ACTGG AAAGC TTCTG AGGGA GCTGA ATATG

401 ATGAT CAGAC CAGTC AAAGG GAGAA AGAAG ATGAT AAAGT CTTCC CTGGT

451 GGAAG CCATA CATAT GTCTG GCAGG TCCTG AAAGA GAATG GTCCA ATGGC

501 CTCTG ACCCA CTGTG CCTTA CCTAC TCATA TCTTT CTCAT GTGGA CCTGG

551 TAAAA GACTT GAATT CAGGC CTCAT GGAG CCCTA CTAGT ATGTA GAGAA

601 GGGAG TCTGG CCAAG GAAAA GACAC AGACC TTGCA CAAAT TTATA CTACT

651 TTTTG CTGTA TTTGA TGAAG GGAAA AGTTG GCACT CAGAA ACAAA GAACT

701 CCTTG ATGCA GGATA GGGAT GCTGC ATCTG CTCGG GCCTG GCCTA AAATG
```

```
 751 CACAC AGTCA ATGGT TATGT AAACA GGTCT CTGCC AGGTC TGATT GGATG

801 CCACA GGAAA TCAGT CTATT GGCAT GTGAT TGGAA TGGGC ACCAC TCCTG

851 AAGTG CACTC AATAT CCTCG AAGG TCACA CATTT CTTGT GAGGA ACCAT

901 CGCCA GGCTA GCTTG GAAAT CTCGC CAATA ACTTT CCTTA CTGCT CAAAC

951 ACTCT TGATG GACCT TGGAC AGTTT CTACT GTTTT GTCAT ATCTC TTCCC

1001 ACCAA CATGA TGGCA TGGAA GCTTA TGTCA AAGTA GACAG CTGTC CAGAG

1051 GAACC CCAAC TACGA ATGAA AAATA ATGAA GAAGC GGAAG ACTAT GATGA

1101 TGATC TTACT GATTC TGAAA TGGAT GTGGT CAGGT TTGAT GATGA CAACT

1151 CTCCT TCCTT TATCC AAATT CGCTC AGTTG CCAAG AAGCA TCCTA AAACT

1201 TGGGT ACATT ACATT GCTGC TGAAG AGGAG ACTG GGACT ATGCT CCCTT

1251 AGTCC TCGCC CCCGA TGACA GAAGT TATAA AAGTC AATAT TTGAA CAATG

1301 GCCCT CAGCG GATTG GTAGG AAGTA CAAAA AGTC CGATT TATGG CATAC

1351 ACAGA TGAAA CCTTT AAGAC TCGTG AAGCT ATTCA GCATG AATCA GGAAT

1401 CTTGG GACCT TTACT TTATG GGGAA GTTGG AGACA CACTG TTGAT TATAT

1451 TTAAG AATCA AGCAA GCAGA CCATA TAACA TCTAC CCTCA CGGAA TCACT

1501 GATGT CCGTC CTTTG TATTC AAGGA GATTA CCAAA AGGTG TAAAA CATTT

1551 GAAGG ATTTT CCAAT TCTGC AGGA GAAAT ATTCA AATAT AAATG GACAG

1601 TGACT GTAGA AGATG GCCCA ACTAA ATCAG ATCCT CGGTG CCTGA CCCGC

1651 TATTA CTCTA GTTTC GTTAA TATGG AGAGA GATCT AGCTT CAGGA CTCAT

1701 TGGCC CTCTC CTCAT CTGCT ACAAA GAATC TGTAG ATCAA AGAGG AAACC

1751 AGATA ATGTC AGACA AGAGG AATGT CATCC TGTTT TCTGT ATTTG ATGAG

1801 AACCG AAGCT GGTAC CTCAC AGAGA ATATA CAACG CTTTC TCCCC AATCC

1851 AGCTG GAGTG CAGCT TGAGG ATCCA GAGTT CCAAG CCTCC AACAT CATGC

1901 ACAGC ATCAA TGGCT ATGTT TTTGA TAGTT TGCAG TTGTC AGTTT GTTTG

1951 CATGA GGTGG CATAC TGGTA CATTC TAAGC ATTGG AGCAC AGACT GACTT

2001 CCTTT CTGTC TTCTT CTCTG GATAT ACCTT CAAAC ACAAA ATGGT CTATG

2051 AAGAC ACACT CACCC TATTC CCATT CTCAG GAGAA ACTGT CTTCA TGTCG

2101 ATGGA AAACC CAGGT CTATG GATTC TGGGG TGCCA CAACT CAGAC TTTCG

2151 GAACA GAGGC ATGAC CGCCT TACTG AAGGT TTCTA GTTGT GACAA GAACA

2201 CTGGT GATTA TTACG AGGAC AGTTA TGAAG ATATT TCAGC ATACT TGCTG

2251 AGTAA AAACA ATGCC ATTGA ACCAA GAAGC TTCTC TCAAA CGGC GCGCC

2301 AGGTA CCTCA GAGTC TGCTA CCCCC GAGTC AGGGC AGGA TCAGA GCCAG

2351 CCACC TCCGG GTCTG AGACA CCCGG GACTT CCGAG AGTGC ACCC CTGAG

2401 TCCGG ACCCG GGTCC GAGCC CGCCA CTTCC GGCTC CGAAA CTCCC GGCAC

2451 AAGCG AGAGC GCTAC CCCAG AGTCA GGACC AGGAA CATCT ACAGA GCCCT

2501 CTGAA GGCTC CGCTC CAGGG TCCCC AGCCG GCAGT CCCAC TAGCA CCGAG

2551 GAGGG AACCT CTGAA AGCGC ACAC CCGAA TCAGG GCCAG GGTCT GAGCC

2601 TGCTA CCAGC GGCAG CGAGA CACCA GGCAC CTCTG AGTCC GCCAC ACCAG

2651 AGTCC GGACC CGGAT CTCCC GCTGG GAGCC CCACC TCCAC TGAGG AGGGA

2701 TCTCC TGCTG GCTCT CCAAC ATCTA CTGAG GAAGG TACCT CAACC GAGCC
```

```
2751  ATCCG AGGGA TCAGC TCCCG GCACC TCAGA GTCGG CAACC CCGGA GTCTG

2801  GACCC GGAAC TTCCG AAAGT GCCAC ACCAG AGTCC GGTCC CGGGA CTTCA

2851  GAATC AGCAA CACCC GAGTC CGGCC CTGGG TCTGA ACCCG CCACA GTGG

2901  TAGTG AGACA CCAGG ATCAG AACCT GCTAC CTCAG GGTCA GAGAC ACCCG

2951  GATCT CCGGC AGGCT CACCA ACCTC CACTG AGGAG GGCAC CAGCA CAGAA

3001  CCAAG CGAGG GCTCC GCACC CGGAA CAAGC ACTGA ACCCA GTGAG GGTTC

3051  AGCAC CCGGC TCTGA GCCGG CCACA GTGG CAGTG AGACA CCCGG CACTT

3101  CAGAG AGTGC CACCC CCGAG AGTGG CCCAG GCACT AGTAC CGAGC CCTCT

3151  GAAGG CAGTG CGCCA GCCTC GAGCC CACCA GTCTT GAAAC GCCAT CAAGC

3201  TGAAA TAACT CGTAC TACTC TTCAG TCAGA TCAAG AGGAA ATCGA TTATG

3251  ATGAT ACCAT ATCAG TTGAA ATGAA GAAGG AAGAT TTTGA CATTT ATGAT

3301  GAGGA TGAAA ATCAG AGCCC CCGCA GCTTT CAAAA GAAAA CACGA CACTA

3351  TTTTA TTGCT GCAGT GGAGA GGCTC TGGGA TTATG GGATG AGTAG CTCCC

3401  CACAT GTTCT AAGAA ACAGG GCTCA GAGTG GCAGT GTCCC TCAGT TCAAG

3451  AAAGT TGTTT CCAG GAATT TACTG ATGGC TCCTT TACTC AGCCC TTATA

3501  CCGTG GAGAA CTAAA TGAAC ATTTG GGACT CCTGG GGCCA TATAT AAGAG

3551  CAGAA GTTGA AGATA ATATC ATGGT AACTT TCAGA AATCA GGCCT CTCGT

3601  CCCTA TTCCT TCTAT TCTAG CCTTA TTTCT TATGA GGAAG ATCAG AGGCA

3651  AGGAG CAGAA CCTAG AAAAA ACTTT GTCAA GCCTA ATGAA ACCAA AACTT

3701  ACTTT TGGAA AGTGC AACAT CATAT GGCAC CCACT AAAGA TGAGT TTGAC

3751  TGCAA AGCCT GGGCT TATTT CTCTG ATGTT GACCT GGAAA AAGAT GTGCA

3801  CTCAG GCCTG ATTGG ACCCC TTCTG GTCTG CCACA CTAAC ACACT GAACC

3851  CTGCT CATGG GAGAC AAGTG ACAGT ACAGG AATTT GCTCT GTTTT TCACC

3901  ATCTT TGATG AGACC AAAAG CTGGT ACTTC ACTGA AAATA TGGAA AGAAA

3951  CTGCA GGGCT CCCTG CAATA TCCAG ATGGA AGATC CCACT TTTAA AGAGA

4001  ATTAT CGCTT CCATG CAATC AATGG CTACA TAATG GATAC ACTAC CTGGC

4051  TTAGT AATGG CTCAG GATCA AAGGA TTCGA TGGTA TCTGC TCAGC ATGGG

4101  CAGCA ATGAA AACAT CCATT CTATT CATTT CAGTG GACAT GTGTT CACTG

4151  TACGA AAAAA AGAGG AGTAT AAAAT GGCAC TGTAC AATCT CTATC CAGGT

4201  GTTTT TGAGA CAGTG GAAAT GTTAC CATCC AAAGC TGGAA TTTGG CGGGT

4251  GGAAT GCCTT ATTGG CGAGC ATCTA CATGC TGGGA TGAGC ACACT TTTTC

4301  TGGTG TACAG CAATA AGTGT CAGAC TCCCC TGGGA ATGGC TTCTG GACAC

4351  ATTAG AGATT TTCAG ATTAC AGCTT CAGGA CAATA TGGAC AGTGG GCCCC

4401  AAAGC TGGCC AGACT TCATT ATTCC GGATC AATCA ATGCC TGGAG CACCA

4451  AGGAG CCCTT TTCTT GGATC AAGGT GGATC TGTTG GCACC AATGA TTATT

4501  CACGG CATCA AGACC CAGGG TGCCC GTCAG AAGTT CTCCA GCCTC TACAT

4551  CTCTC AGTTT ATCAT CATGT ATAGT CTTGA TGGGA AGAAG TGGCA GACTT

4601  ATCGA GGAAA TTCCA CTGGA ACCTT AATGG TCTTC TTTGG CAATG TGGAT

4651  TCATC TGGGA TAAAA CACAA TATTT TTAAC CCTCC AATTA TTGCT CGATA
```

-continued

```
4701 CATCC GTTTG CACCC AACTC ATTAT AGCAT TCGCA GCACT CTTCG CATGG
4751 AGTTG ATGGG CTGTG ATTTA AATAG TTGCA GCATG CCATT GGGAA TGGAG
4801 AGTAA AGCAA TATCA GATGC ACAGA TTACT GCTTC ATCCT ACTTT ACCAA
4851 TATGT TTGCC ACCTG GTCTC CTTCA AAAGC TCGAC TTCAC CTCCA AGGGA
4901 GGAGT AATGC TGGA GACCT CAGGT GAATA ATCCA AAAGA GTGGC TGCAA
4951 GTGGA CTTCC AGAAG ACAAT GAAAG TCACA GGAGT AACTA CTCAG GGAGT
5001 AAAAT CTCTG CTTAC AGCA TGTAT GTGAA GGAGT CCTC ATCTC CAGCA
5051 GTCAA GATGG CCATC AGTGG ACTCT CTTTT TTCAG AATGG CAAAG TAAAG
5101 GTTTT TCAGG GAAAT CAAGA CTCCT TCACA CCTGT GGTGA ACTCT CTAGA
5151 CCCAC CGTTA CTGAC TCGCT ACCTT CGAAT TCACC CCCAG AGTTG GGTGC
5201 ACCAG ATTGC CCTGA GGATG GAGGT TCTGG GCTGC GAGGC ACAGG ACCTC
5251 TACGA CAAAA CTCAC ACATG CCCAC CGTGC CCAGC TCCAG AACTC CTGGG
5301 CGGAC CGTCA GTCTT CCTCT TCCCC CCAAA ACCCA AGGAC ACCCT CATGG
5351 CCTCC CGGAC CCCTG AGGTC ACATG CGTGG TGGTG GACGT GAGCC ACGAA
5401 GACCC TGAGG TCAAG TTCAA CTGGT ACGTG GACGG CGTGG AGGTG CATAA
5451 TGCCA AGACA AAGCC GCGGG AGGAG CAGTA CAACA GCACG TACCG TGTGG
5501 TCAGC GTCCT CACCG TCCTG GCCCA GGACT GGCTG AATGG CAAGG AGTAC
5551 AAGTG CAAGG TCTCC AACAA AGCCC TCCCA GCCCC CATCG AGAAA ACCAT
5601 CTCCA AAGCC AAAGG GCAGC CCCGA GAACC ACAGG TGTAC ACCCT GCCCC
5651 CATCC CGGGA TGAGC TGACC AAGAA CCAGG TCAGC CTGAC CTGCC TGGTC
5701 AAAGG CTTCT ATCCC AGCGA CATCG CCGTG GAGTG GGAGA GCAAT GGGCA
5751 GCCGG AGAAC AACTA CAAGA CCACG CCTCC CGTGT GGACT CCGA CGGCT
5801 CCTTC TTCCT CTACA GCAAG CTCAC CGTGG ACAAG AGCAG GTGGC AGCAG
5851 GGGAA CGTCT TCTCA TGCTC CGTGA TGCAT GAGGC TCTGC ACAAC GCCTA
5901 CACGC AGAAG AGCCT CTCCC TGTCT CCGGG TAAAT GA
```

FVIII 283 protein sequence (FVIII 169 with IHH triple mutation)
(SEQ ID NO: 161)

```
  1 MQIELSTCFF LCLLRFCFSA TRRYYLGAVE LSWDYMQSDL GELPVDARFP
 51 PRVPKSFPFN TSVVYKKTLF VEFTDHLFNI AKPRPPWMGL LGPTIQAEVY
101 DTVVITLKNM ASHPVSLHAV GVSYWKASEG AEYDDQTSQR EKEDDKVFPG
151 GSHTYVWQVL KENGPMASDP LCLTYSYLSH VDLVKDLNSG LIGALLVCRE
201 GSLAKEKTQT LHKFILLFAV FDEGKSWHSE TKNSLMQDRD AASARAWPKM
251 HTVNGYVNRS LPGLIGCHRK SVYWHVIGMG TTPEVHSIFL EGHTFLVRNH
301 RQASLEISPI TFLTAQTLLM DLGQFLLFCH ISSHQHDGME AYVKVDSCPE
351 EPQLRMKNNE EAEDYDDDLT DSEMDVVRFD DDNSPSFIQI RSVAKKHPKT
401 WVHYIAAEEE DWDYAPLVLA PDDRSYKSQY LNNGPQRIGR KYKKVRFMAY
451 TDETFKTREA IQHESGILGP LLYGEVGDTL LIIFKNQASR PYNIYPHGIT
501 DVRPLYSRRL PKGVKHLKDF PILPGEIFKY KWTVTVEDGP TKSDPRCLTR
551 YYSSFVNMER DLASGLIGPL LICYKESVDQ RGNQIMSDKR NVILFSVFDE
601 NRSWYLTENI QRFLPNPAGV QLEDPEFQAS NIMHSINGYV FDSLQLSVCL
651 HEVAYWYILS IGAQTDFLSV FFSGYTFKHK MVYEDTLTLF PFSGETVFMS
```

```
 701 MENPGLWILG CHNSDFRNRG MTALLKVSSC DKNTGDYYED SYEDISAYLL
 751 SKNNAIEPRS FSQNGAPGTS ESATPESGPG SEPATSGSET PGTSESATPE
 801 SGPGSEPATS GSETPGTSES ATPESGPGTS TEPSEGSAPG SPAGSPTSTE
 851 EGTSESATPE SGPGSEPATS GSETPGTSES ATPESGPGSP AGSPTSTEEG
 901 SPAGSPTS1E EGTSTEPSEG SAPGTSESAT PESGPGTSES ATPESGPGTS
 951 ESATPESGPG SEPATSGSET PGSEPATSGS ETPGSPAGSP TSTEEGTSTE
1001 PSEGSAPGTS TEPSEGSAPG SEPATSGSET PGTSESATPE SGPGTSTEPS
1051 EGSAPASSPP VLKRHQAEIT RTTLQSDQEE IDYDDTISVE MKKEDFDIYD
1101 EDENQSPRSF QKKTRHYFIA AVERLWDYGM SSSPHVLRNR AQSGSVPQFK
1151 KVVFQEFTDG SFTQPLYRGE LNEHLGLLGP YIRAEVEDNI MVTFRNQASR
1201 PYSFYSSLIS YEEDQRQGAE PRKNFVKPNE TKTYFWKVQH HMAPTKDEFD
1251 CKAWAYFSDV DLEKDVHSGL IGPLLVCHTN TLNPAHGRQV TVQEFALFFT
1301 IFDETKSWYF TENMERNCRA PCNIQMEDPT FKENYRFHAI NGYIMDTLPG
1351 LVMAQDQRIR WYLLSMGSNE NIHSIHFSGH VFTVRKKEEY KMALYNLYPG
1401 VFETVEMLPS KAGIWRVECL IGEHLHAGMS TLFLVYSNKC QTPLGMASGH
1451 IRDFQITASG QYGQWAPKLA RLHYSGSINA WSTKEPFSWI KVDLLAPMII
1501 HGIKTQGARQ KFSSLYISQF IIMYSLDGKK WQTYRGNSTG TLMVFFGNVD
1551 SSGIKHNIFN PPIIARYIRL HPTHYSIRST LRMELMGCDL NSCSMPLGME
1601 SKAISDAQIT ASSYFTNMFA TWSPSKARLH LQGRSNAWRP QVNNPKEWLQ
1651 VDFQKTMKVT GVTTQGVKSL LTSMYVKEFL ISSSQDGHQW TLFFQNGKVK
1701 VFQGNQDSFT PVVNSLDPPL LTRYLRIHPQ SWVHQIALRM EVLGCEAQDL
1751 YDKTHTCPPC PAPELLGGPS VFLFPPKPKD TLMASRTPEV TCVVVDVSHE
1801 DPEVKFNWYV DGVEVHNAKT KPREEQYNST YRVVSVLTVL AQDWLNGKEY
1851 KCKVSNKALP APIEKTISKA KGQPREPQVY TLPPSRDELT KNQVSLTCLV
1901 KGFYPSDIAV EWESNGQPEN NYKTTPPVLD SDGSFFLYSK LTVDKSRWQQ
1951 GNVFSCSVMH EALHNAYTQK SLSLSPGK*
pSYNFVIII 010 nucleotide sequence-(Dual chain FVIIIFc)
                                                            (SEQ ID NO: 162)
   1 ATGCAAATAG AGCTCTCCAC CTGCTTCTTT CTGTGCCTTT TGCGATTCTG
  51 CTTTAGTGCC ACCAGAAGAT ACTACCTGGG TGCAGTGGAA CTGTCATGGG
 101 ACTATATGCA AAGTGATCTC GGTGAGCTGC CTGTGGACGC AAGATTTCCT
 151 CCTAGAGTGC AAAATCTTT TCCATTCAAC ACCTCAGTCG TGTACAAAAA
 201 GACTCTGTTT GTAGAATTCA CGGATCACCT TTTCAACATC GCTAAGCCAA
 251 GGCCACCCTG GATGGGTCTG CTAGGTCCTA CCATCCAGGC TGAGGTTTAT
 301 GATACAGTGG TCATTACACT TAAGAACATG GCTTCCCATC CTGTCAGTCT
 351 TCATGCTGTT GGTGTATCCT ACTGGAAAGC TTCTGAGGGA GCTGAATATG
 401 ATGATCAGAC CAGTCAAAGG GAGAAAGAAG ATGATAAAGT CTTCCCTGGT
 451 GGAAGCCATA CATATGTCTG GCAGGTCCTG AAAGAGAATG GTCCAATGGC
 501 CTCTGACCCA CTGTGCCTTA CCTACTCATA TCTTTCTCAT GTGGACCTGG
 551 TAAAAGACTT GAATTCAGGC CTCATTGGAG CCCTACTAGT ATGTAGAGAA
```

```
 601 GGGAGTCTGG CCAAGGAAAA GACACAGACC TTGCACAAAT TTATACTACT

651 TTTTGCTGTA TTTGATGAAG GGAAAAGTTG GCACTCAGAA ACAAAGAACT

701 CCTTGATGCA GGATAGGGAT GCTGCATCTG CTCGGGCCTG GCCTAAAATG

751 CACACAGTCA ATGGTTATGT AAACAGGTCT CTGCCAGGTC TGATTGGATG

801 CCACAGGAAA TCAGTCTATT GGCATGTGAT TGGAATGGGC ACCACTCCTG

851 AAGTGCACTC AATATTCCTC GAAGGTCACA CATTTCTTGT GAGGAACCAT

901 CGCCAGGCGT CCTTGGAAAT CTCGCCAATA ACTTTCCTTA CTGCTCAAAC

951 ACTCTTGATG GACCTTGGAC AGTTTCTACT GTTTTGTCAT ATCTCTTCCC

1001 ACCAACATGA TGGCATGGAA GCTTATGTCA AGTAGACAG CTGTCCAGAG

1051 GAACCCCAAC TACGAATGAA AAATAATGAA GAAGCGGAAG ACTATGATGA

1101 TGATCTTACT GATTCTGAAA TGGATGTGGT CAGGTTTGAT GATGACAACT

1151 CTCCTTCCTT TATCCAAATT CGCTCAGTTG CCAAGAAGCA TCCTAAAACT

1201 TGGGTACATT ACATTGCTGC TGAAGAGGAG GACTGGGACT ATGCTCCCTT

1251 AGTCCTCGCC CCCGATGACA GAAGTTATAA AGTCAATAT TTGAACAATG

1301 GCCCTCAGCG GATTGGTAGG AAGTACAAAA AAGTCCGATT TATGGCATAC

1351 ACAGATGAAA CCTTTAAGAC TCGTGAAGCT ATTCAGCATG AATCAGGAAT

1401 CTTGGGACCT TTACTTTATG GGGAAGTTGG AGACACACTG TTGATTATAT

1451 TTAAGAATCA AGCAAGCAGA CCATATAACA TCTACCCTCA CGGAATCACT

1501 GATGTCCGTC CTTTGTATTC AAGGAGATTA CCAAAAGGTG TAAAACATTT

1551 GAAGGATTTT CCAATTCTGC CAGGAGAAAT ATTCAAATAT AAATGGACAG

1601 TGACTGTAGA AGATGGGCCA ACTAAATCAG ATCCTCGGTG CCTGACCCGC

1651 TATTACTCTA GTTTCGTTAA TATGGAGAGA GATCTAGCTT CAGGACTCAT

1701 TGGCCCTCTC CTCATCTGCT ACAAAGAATC TGTAGATCAA AGAGGAAACC

1751 AGATAATGTC AGACAAGAGG AATGTCATCC TGTTTTCTGT ATTTGATGAG

1801 AACCGAAGCT GGTACCTCAC AGAGAATATA CAACGCTTTC TCCCCAATCC

1851 AGCTGGAGTG CAGCTTGAGG ATCCAGAGTT CCAAGCCTCC AACATCATGC

1901 ACAGCATCAA TGGCTATGTT TTTGATAGTT TGCAGTTGTC AGTTTGTTTG

1951 CATGAGGTGG CATACTGGTA CATTCTAAGC ATTGGAGCAC AGACTGACTT

2001 CCTTTCTGTC TTCTTCTCTG GATATACCTT CAAACACAAA ATGGTCTATG

2051 AAGACACACT CACCCTATTC CCATTCTCAG GAGAAACTGT CTTCATGTCG

2101 ATGGAAAACC CAGGTCTATG GATTCTGGGG TGCCACAACT CAGACTTTCG

2151 GAACAGAGGC ATGACCGCCT TACTGAAGGT TTCTAGTTGT GACAAGAACA

2201 CTGGTGATTA TTACGAGGAC AGTTATGAAG ATATTTCAGC ATACTTGCTG

2251 AGTAAAAACA ATGCCATTGA ACCAAGAAGC TTCTCTCAAA ACCCACCAGT

2301 CTTGAAACGC CATCAACGGG AAATAACTCG TACTACTCTT CAGTCAGATC

2351 AAGAGGAAAT TGACTATGAT GATACCATAT CAGTTGAAAT GAAGAAGGAA

2401 GATTTTGACA TTTATGATGA GGATGAAAAT CAGAGCCCCC GCAGCTTTCA

2451 AAAGAAAACA CGACACTATT TTATTGCTGC AGTGGAGAGG CTCTGGGATT

2501 ATGGGATGAG TAGCTCCCCA CATGTTCTAA GAAACAGGGC TCAGAGTGGC

2551 AGTGTCCCTC AGTTCAAGAA AGTTGTTTTC CAGGAATTTA CTGATGGCTC
```

-continued

```
2601  CTTTACTCAG CCCTTATACC GTGGAGAACT AAATGAACAT TTGGGACTCC
2651  TGGGGCCATA TATAAGAGCA GAAGTTGAAG ATAATATCAT GGTAACTTTC
2701  AGAAATCAGG CCTCTCGTCC CTATTCCTTC TATTCTAGCC TTATTTCTTA
2751  TGAGGAAGAT CAGAGGCAAG GAGCAGAACC TAGAAAAAAC TTTGTCAAGC
2801  CTAATGAAAC CAAAACTTAC TTTTGGAAAG TGCAACATCA TATGGCACCC
2851  ACTAAAGATG AGTTTGACTG CAAAGCCTGG GCTTATTTCT CTGATGTTGA
2901  CCTGGAAAAA GATGTGCACT CAGGCCTGAT TGGACCCCTT CTGGTCTGCC
2951  ACACTAACAC ACTGAACCCT GCTCATGGGA GACAAGTGAC AGTACAGGAA
3001  TTTGCTCTGT TTTTCACCAT CTTTGATGAG ACCAAAAGCT GGTACTTCAC
3051  TGAAAATATG GAAAGAAACT GCAGGGCTCC CTGCAATATC CAGATGGAAG
3101  ATCCCACTTT TAAAGAGAAT TATCGCTTCC ATGCAATCAA TGGCTACATA
3151  ATGGATACAC TACCTGGCTT AGTAATGGCT CAGGATCAAA GGATTCGATG
3201  GTATCTGCTC AGCATGGGCA GCAATGAAAA CATCCATTCT ATTCATTTCA
3251  GTGGACATGT GTTCACTGTA CGAAAAAAAG AGGAGTATAA AATGGCACTG
3301  TACAATCTCT ATCCAGGTGT TTTTGAGACA GTGGAAATGT TACCATCCAA
3351  AGCTGGAATT TGGCGGGTGG AATGCCTTAT GGCGAGCAT CTACATGCTG
3401  GGATGAGCAC ACTTTTTCTG GTGTACAGCA ATAAGTGTCA GACTCCCCTG
3451  GGAATGGCTT CTGGACACAT TAGAGATTTT CAGATTACAG CTTCAGGACA
3501  ATATGGACAG TGGGCCCCAA AGCTGGCCAG ACTTCATTAT TCCGGATCAA
3551  TCAATGCCTG GAGCACCAAG GAGCCCTTTT CTTGGATCAA GGTGGATCTG
3601  TTGGCACCAA TGATTATTCA CGGCATCAAG ACCCAGGGTG CCCGTCAGAA
3651  GTTCTCCAGC CTCTACATCT CTCAGTTTAT CATCATGTAT AGTCTTGATG
3701  GGAAGAAGTG GCAGACTTAT CGAGGAAATT CCACTGGAAC CTTAATGGTC
3751  TTCTTTGGCA ATGTGGATTC ATCTGGGATA AAACACAATA TTTTTAACCC
3801  TCCAATTATT GCTCGATACA TCCGTTTGCA CCCAACTCAT TATAGCATTC
3851  GCAGCACTCT TCGCATGGAG TTGATGGGCT GTGATTTAAA TAGTTGCAGC
3901  ATGCCATTGG GAATGGAGAG TAAAGCAATA TCAGATGCAC AGATTACTGC
3951  TTCATCCTAC TTTACCAATA TGTTTGCCAC CTGGTCTCCT TCAAAAGCTC
4001  GACTTCACCT CCAAGGGAGG AGTAATGCCT GGAGACCTCA GGTGAATAAT
4051  CCAAAAGAGT GGCTGCAAGT GGACTTCCAG AAGACAATGA AAGTCACAGG
4101  AGTAACTACT CAGGGAGTAA AATCTCTGCT TACCAGCATG TATGTGAAGG
4151  AGTTCCTCAT CTCCAGCAGT CAAGATGGCC ATCAGTGGAC TCTCTTTTTT
4201  CAGAATGGCA AAGTAAAGGT TTTTCAGGGA AATCAAGACT CCTTCACACC
4251  TGTGGTGAAC TCTCTAGACC CACCGTTACT GACTCGCTAC CTTCGAATTC
4301  ACCCCCAGAG TTGGGTGCAC CAGATTGCCC TGAGGATGGA GGTTCTGGGC
4351  TGCGAGGCAC AGGACCTCTA CGACAAAACT CACACATGCC ACCGTGCCC
4401  AGCTCCAGAA CTCCTGGGCG GACCGTCAGT CTTCCTCTTC CCCCCAAAAC
4451  CCAAGGACAC CCTCATGATC TCCCGGACCC CTGAGGTCAC ATGCGTGGTG
4501  GTGGACGTGA GCCACGAAGA CCCTGAGGTC AAGTTCAACT GGTACGTGGA
```

|      |                                              |
|------|----------------------------------------------|
| 4551 | CGGCGTGGAG GTGCATAATG CCAAGACAAA GCCGCGGGAG GAGCAGTACA |
| 4601 | ACAGCACGTA CCGTGTGGTC AGCGTCCTCA CCGTCCTGCA CCAGGACTGG |
| 4651 | CTGAATGGCA AGGAGTACAA GTGCAAGGTC TCCAACAAAG CCCTCCCAGC |
| 4701 | CCCCATCGAG AAAACCATCT CCAAAGCCAA AGGGCAGCCC CGAGAACCAC |
| 4751 | AGGTGTACAC CCTGCCCCCA TCCCGGGATG AGCTGACCAA GAACCAGGTC |
| 4801 | AGCCTGACCT GCCTGGTCAA AGGCTTCTAT CCCAGCGACA TCGCCGTGGA |
| 4851 | GTGGGAGAGC AATGGGCAGC CGGAGAACAA CTACAAGACC ACGCCTCCCG |
| 4901 | TGTTGGACTC CGACGGCTCC TTCTTCCTCT ACAGCAAGCT CACCGTGGAC |
| 4951 | AAGAGCAGGT GGCAGCAGGG GAACGTCTTC TCATGCTCCG TGATGCATGA |
| 5001 | GGCTCTGCAC AACCACTACA CGCAGAAGAG CCTCTCCCTG TCTCCGGGTA |
| 5051 | AATGA                                                 | pSYNFVIII 010 protein sequence-(Dual chain FVIIIFc)

(SEQ ID NO: 163)

|      |            |            |            |            |
|------|------------|------------|------------|------------|
|    1 | MQIELSTCFF | LCLLRFCFSA | TRRYYLGAVE | LSWDYMQSDL GELPVDARFP |
|   51 | PRVPKSFPFN | TSVVYKKTLF | VEFTDHLFNI | AKPRPPWMGL LGPTIQAEVY |
|  101 | DTVVITLKNM | ASHPVSLHAV | GVSYWKASEG | AEYDDQTSQR EKEDDKVFPG |
|  151 | GSHTYVWQVL | KENGPMASDP | LCLTYSYLSH | VDLVKDLNSG LIGALLVCRE |
|  201 | GSLAKEKTQT | LHKFILLFAV | FDEGKSWHSE | TKNSLMQDRD AASARAWPKM |
|  251 | HTVNGYVNRS | LPGLIGCHRK | SVYWHVIGMG | TTPEVHSIFL EGHTFLVRNH |
|  301 | RQASLEISPI | TFLTAQTLLM | DLGQFLLFCH | ISSHQHDGME AYVKVDSCPE |
|  351 | EPQLRMKNNE | EAEDYDDDLT | DSEMDVVRFD | DDNSPSFIQI RSVAKKHPKT |
|  401 | WVHYIAAEEE | DWDYAPLVLA | PDDRSYKSQY | LNNGPQRIGR KYKKVRFMAY |
|  451 | TDETFKTREA | IQHESGILGP | LLYGEVGDTL | LIIFKNQASR PYNIYPHGIT |
|  501 | DVRPLYSRRL | PKGVKHLKDF | PILPGEIFKY | KWTVTVEDGP TKSDPRCLTR |
|  551 | YYSSFVNMER | DLASGLIGPL | LICYKESVDQ | RGNQIMSDKR NVILFSVFDE |
|  601 | NRSWYLTENI | QRFLPNPAGV | QLEDPEFQAS | NIMHSINGYV FDSLQLSVCL |
|  651 | HEVAYWYILS | IGAQTDFLSV | FFSGYTFKHK | MVYEDTLTLF PFSGETVFMS |
|  701 | MENPGLWILG | CHNSDFRNRG | MTALLKVSSC | DKNTGDYYED SYEDISAYLL |
|  751 | SKNNAIEPRS | FSQNPPVLKR | HQREITRTTL | QSDQEEIDYD DTISVEMKKE |
|  801 | DFDIYDEDEN | QSPRSFQKKT | RHYFIAAVER | LWDYGMSSSP HVLRNRAQSG |
|  851 | SVPQFKKVVF | QEFTDGSFTQ | PLYRGELNEH | LGLLGPYIRA EVEDNIMVTF |
|  901 | RNQASRPYSF | YSSLISYEED | QRQGAEPRKN | FVKPNETKTY FWKVQHHMAP |
|  951 | TKDEFDCKAW | AYFSDVDLEK | DVHSGLIGPL | LVCHTNTLNP AHGRQVTVQE |
| 1001 | FALFFTIFDE | TKSWYFTENM | ERNCRAPCNI | QMEDPTFKEN YRFHAINGYI |
| 1051 | MDTLPGLVMA | QDQRIRWYLL | SMGSNENIHS | IHFSGHVFTV RKKEEYKMAL |
| 1101 | YNLYPGVFET | VEMLPSKAGI | WRVECLIGEH | LHAGMSTLFL VYSNKCQTPL |
| 1151 | GMASGHIRDF | QITASGQYGQ | WAPKLARLHY | SGSINAWSTK EPFSWIKVDL |
| 1201 | LAPMIIHGIK | TQGARQKFSS | LYISQFIIMY | SLDGKKWQTY RGNSTGTLMV |
| 1251 | FFGNVDSSGI | KHNIFNPPII | ARYIRLHPTH | YSIRSTLRME LMGCDLNSCS |
| 1301 | MPLGMESKAI | SDAQITASSY | FTNMFATWSP | SKARLHLQGR SNAWRPQVNN |
| 1351 | PKEWLQVDFQ | KTMKVTGVTT | QGVKSLLTSM | YVKEFLISSS QDGHQWTLFF |

```
1401 QNGKVKVFQG NQDSFTPVVN SLDPPLLTRY LRIHPQSWVH QIALRMEVLG

1451 CEAQDLYDKT HTCPPCPAPE LLGGPSVFLF PPKPKDTLMI SRTPEVTCVV

1501 VDVSHEDPEV KFNWYVDGVE VHNAKTKPRE EQYNSTYRVV SVLTVLHQDW

1551 LNGKEYKCKV SNKALPAPIE KTISKAKGQP REPQVYTLPP SRDELTKNQV

1601 SLTCLVKGFY PSDIAVEWES NGQPENNYKT TPPVLDSDGS FFLYSKLTVD

1651 KSRWQQGNVF SCSVMHEALH NHYTQKSLSL SPGK*
```

FVIII 195 protein sequence (dual chain FVIIIFc with two
144 AE XTENs at amino acid 1656 and 1900)

(SEQ ID NO: 73)

```
   1 MQIELSTCFF LCLLRFCFSA TRRYYLGAVE LSWDYMQSDL GELPVDARFP

51 PRVPKSFPFN TSVVYKKTLF VEFTDHLFNI AKPRPPWMGL LGPTIQAEVY

101 DTVVITLKNM ASHPVSLHAV GVSYWKASEG AEYDDQTSQR EKEDDKVFPG

151 GSHTYVWQVL KENGPMASDP LCLTYSYLSH VDLVKDLNSG LIGALLVCRE

201 GSLAKEKTQT LHKFILLFAV FDEGKSWHSE TKNSLMQDRD AASARAWPKM

251 HTVNGYVNRS LPGLIGCHRK SVYWHVIGMG TTPEVHSIFL EGHTFLVRNH

301 RQASLEISPI TFLTAQTLLM DLGQFLLFCH ISSHQHDGME AYVKVDSCPE

351 EPQLRMKNNE EAEDYDDDLT DSEMDVVRFD DDNSPSFIQI RSVAKKHPKT

401 WVHYIAAEEE DWDYAPLVLA PDDRSYKSQY LNNGPQRIGR KYKKVRFMAY

451 TDETFKTREA IQHESGILGP LLYGEVGDTL LIIFKNQASR PYNIYPHGIT

501 DVRPLYSRRL PKGVKHLKDF PILPGEIFKY KWTVTVEDGP TKSDPRCLTR

551 YYSSFVNMER DLASGLIGPL LICYKESVDQ RGNQIMSDKR NVILFSVFDE

601 NRSWYLTENI QRFLPNPAGV QLEDPEFQAS NIMHSINGYV FDSLQLSVCL

651 HEVAYWYILS IGAQTDFLSV FFSGYTFKHK MVYEDTLTLF PFSGETVFMS

701 MENPGLWILG CHNSDFRNRG MTALLKVSSC DKNTGDYYED SYEDISAYLL

751 SKNNAIEPRS FSQNPPVLKR HQREITRTTL QGAPGTPGSG TASSSPGASP

801 GTSSTGSPGA SPGTSSTGSP GASPGTSSTG SPGSSPSAST GTGPGTPGSG

851 TASSSPGASP GTSSTGSPGA SPGTSSTGSP GASPGTSSTG SPGSSTPSGA

901 TGSPGSSTPS GATGSPGASP GTSSTGSPAS SSDQEEIDYD DTISVEMKKE

951 DFDIYDEDEN QSPRSFQKKT RHYFIAAVER LWDYGMSSSP HVLRNRAQSG

1001 SVPQFKKVVF QEFTDGSFTQ PLYRGELNEH LGLLGPYIRA EVEDNIMVTF

1051 RNQASRPYSF YSSLISYEED QRQGAEPRKN FVKPNETKTY FWKVQHHMAP

1101 TKDEFDCKAW AYFSDVDLEK DVHSGLIGPL LVCHTNTLNP AHGRQVTVQE

1151 FALFFTIFDE TKSWYFTENM ERNCRGAPTS ESATPESGPG SEPATSGSET

1201 PGTSESATPE SGPGSEPATS GSETPGTSES ATPESGPGTS TEPSEGSAPG

1251 TSESATPESG PGSPAGSPTS IEEGSPAGSP TSTEEGSPAG SPTSTEEGTS

1301 ESATPESGPG TSTEPSEGSA PGASSAPCNI QMEDPTFKEN YRFHAINGYI

1351 MDTLPGLVMA QDQRIRWYLL SMGSNENIHS IHFSGHVFTV RKKEEYKMAL

1401 YNLYPGVFET VEMLPSKAGI WRVECLIGEH LHAGMSTLFL VYSNKCQTPL

1451 GMASGHIRDF QITASGQYGQ WAPKLARLHY SGSINAWSTK EPFSWIKVDL

1501 LAPMIIHGIK TQGARQKFSS LYISQFIIMY SLDGKKWQTY RGNSTGTLMV

1551 FFGNVDSSGI KHNIFNPPII ARYIRLHPTH YSIRSTLRME LMGCDLNSCS
```

```
1601  MPLGMESKAI SDAQITASSY FTNMFATWSP SKARLHLQGR SNAWRPQVNN

1651  PKEWLQVDFQ KTMKVTGVTT QGVKSLLTSM YVKEFLISSS QDGHQWTLFF

1701  QNGKVKVFQG NQDSFTPVVN SLDPPLLTRY LRIHPQSWVH QIALRMEVLG

1751  CEAQDLYDKT HTCPPCPAPE LLGGPSVFLF PPKPKDTLMI SRTPEVTCVV

1801  VDVSHEDPEV KFNWYVDGVE VHNAKTKPRE EQYNSTYRVV SVLTVLHQDW

1851  LNGKEYKCKV SNKALPAPIE KTISKAKGQP REPQVYTLPP SRDELTKNQV

1901  SLTCLVKGFY PSDIAVEWES NGQPENNYKT TPPVLDSDGS FFLYSKLTVD

1951  KSRWQQGNVF SCSVMHEALH NHYTQKSLSL SPGK*
``` pSYN-FVIII-173 mature Protein sequencing (SEQ ID NO: 72):

```
   1  ATRRYYLGAV ELSWDYMQSD LGELPVDARF PPRVPKSFPF NTSVVYKKTL

51  FVEFTDHLFN IAKPRPPWMG LLGPTIQAEV YDTVVITLKN MASHPVSLHA

101  VGVSYWKASE GAEYDDQTSQ REKEDDKVFP GGSHTYVWQV LKENGPMASD

151  PLCLTYSYLS HVDLVKDLNS GLIGALLVCR EGSLAKEKTQ TLHKFILLFA

201  VFDEGKSWHS ETKNSLMQDR DAASARAWPK MHTVNGYVNR SLPGLIGCHR

251  KSVYWHVIGM GTTPEVHSIF LEGHTFLVRN HRQASLEISP ITFLTAQTLL

301  MDLGQFLLFC HISSHQHDGM EAYVKVDSCP EEPQLRMKNN EEAEDYDDDL

351  TDSEMDVVRF DDDNSPSFIQ IRSVAKKHPK TWVHYIAAEE EDWDYAPLVL

401  APDDRSYKSQ YLNNGPQRIG RKYKKVRFMA YTDETFKTRE AIQHESGILG

451  PLLYGEVGDT LLIIFKNQAS RPYNIYPHGI TDVRPLYSRR LPKGVKHLKD

501  FPILPGEIFK YKWTVTVEDG PTKSDPRCLT RYYSSFVNME RDLASGLIGP

551  LLICYKESVD QRGNQIMSDK RNVILFSVFD ENRSWYLTEN IQRFLPNPAG

601  VQLEDPEFQA SNIMHSINGY VFDSLQLSVC LHEVAYWYIL SIGAQTDFLS

651  VFFSGYTFKH KMVYEDTLTL FPFSGETVFM SMENPGLWIL GCHNSDFRNR

701  GMTALLKVSS CDKNTGDYYE DSYEDISAYL LSKNNAIEPR SFSQNGAPGT

751  SESATPESGP GSEPATSGSE TPGTSESATP ESGPGSEPAT SGSETPGTSE

801  SATPESGPGT STEPSEGSAP GSPAGSPTST EEGTSESATP ESGPGSEPAT

851  SGSETPGTSE SATPESGPGS PAGSPTSTEE GSPAGSPTST EEGTSTEPSE

901  GSAPGTSESA TPESGPGTSE SATPESGPGT SESATPESGP GSEPATSGSE

951  TPGSEPATSG SETPGSPAGS PTSTEEGTST EPSEGSAPGT STEPSEGSAP

1001  GSEPATSGSE TPGTSESATP ESGPGTSTEP SEGSAPASSP PVLKRHQREI

1051  TRTTLQSDQE EIDYDDTISV EMKKEDFDIY DEDENQSPRS FQKKTRHYFI

1101  AAVERLWDYG MSSSPHVLRN RAQSGSVPQF KKVVFQEFTD GSFTQPLYRG

1151  ELNEHLGLLG PYIRAEVEDN IMVTFRNQAS RPYSFYSSLI SYEEDQRQGA

1201  EPRKNFVKPN ETKTYFWKVQ HHMAPTKDEF DCKAWAYFSD VDLEKDVHSG

1251  LIGPLLVCHT NTLNPAHGRQ VTVQEFALFF TIFDETKSWY FIENMERNCR

1301  APCNIQMEDP TFKENYRFHA INGYIMDTLP GLVMAQDQRI RWYLLSMGSN

1351  ENIHSIHFSG HVFTVRKKEE YKMALYNLYP GVFETVEMLP SKAGIWRVEC

1401  LIGEHLHAGM STLFLVYSNK CQTPLGMASG HIRDFQITAS GQYGQWAPKL

1451  ARLHYSGSIN AWSTKEPFSW IKVDLLAPMI IHGIKTQGAR QKFSSLYISQ
```

-continued

```
1501 FIIMYSLDGK KWQTYRGNST GTLMVFFGNV DSSGIKHNIF NPPIIARYIR

1551 LHPTHYSIRS TLRMELMGCD LNSCSMPLGM ESKAISDAQI TASSYFTNMF

1601 ATWSPSKARL HLQGRSNAWR PQVNNPKEWL QVDFQKTMKV TGVTTQGVKS

1651 LLTSMYVKEF LISSSQDGHQ WTLFFQNGKV KVFQGNQDSF TPVVNSLDPP

1701 LLTRYLRIHP QSWVHQIALR MEVLGCEAQD LYDKTHTCPP CPAPELLGGP

1751 SVFLFPPKPK DTLMISRTPE VTCVVVDVSH EDPEVKFNWY VDGVEVHNAK

1801 TKPREEQYNS TYRVVSVLTV LHQDWLNGKE YKCKVSNKAL PAPIEKTISK

1851 AKGQPREPQV YTLPPSRDEL TKNQVSLTCL VKGFYPSDIA VEWESNGQPE

1901 NNYKTTPPVL DSDGSFFLYS KLTVDKSRWQ QGNVFSCSVM HEALHNHYTQ

1951 KSLSLSPGK
```

FVIII 196 protein sequence (dual chain FVIIIFc with three
144 AE XTENs at amino acid 26, 1656 and 1900)

(SEQ ID NO: 74)

```
   1 MQIELSTCFF LCLLRFCFSA TRRYYLGAVE LSWDYMQSDL GELPVGAPGS

51 SPSASTGTGP GSSPSASTGT GPGASPGTSS TGSPGASPGT SSTGSPGSST

101 PSGATGSPGS SPSASTGTGP GASPGTSSTG SPGSSPSAST GTGPGTPGSG

151 TASSSPGSST PSGATGSPGS STPSGATGSP GASPGTSSTG SPASSDARFP

201 PRVPKSFPFN TSVVYKKTLF VEFTDHLFNI AKPRPPWMGL LGPTIQAEVY

251 DTVVITLKNM ASHPVSLHAV GVSYWKASEG AEYDDQTSQR EKEDDKVFPG

301 GSHTYVWQVL KENGPMASDP LCLTYSYLSH VDLVKDLNSG LIGALLVCRE

351 GSLAKEKTQT LHKFILLFAV FDEGKSWHSE TKNSLMQDRD AASARAWPKM

401 HTVNGYVNRS LPGLIGCHRK SVYWHVIGMG TTPEVHSIFL EGHTFLVRNH

451 RQASLEISPI TFLTAQTLLM DLGQFLLFCH ISSHQHDGME AYVKVDSCPE

501 EPQLRMKNNE EAEDYDDDLT DSEMDVVRFD DDNSPSFIQI RSVAKKHPKT

551 WVHYIAAEEE DWDYAPLVLA PDDRSYKSQY LNNGPQRIGR KYKKVRFMAY

601 TDETFKTREA IQHESGILGP LLYGEVGDTL LIIFKNQASR PYNIYPHGIT

651 DVRPLYSRRL PKGVKHLKDF PILPGEIFKY KWTVTVEDGP TKSDPRCLTR

701 YYSSFVNMER DLASGLIGPL LICYKESVDQ RGNQIMSDKR NVILFSVFDE

751 NRSWYLTENI QRFLPNPAGV QLEDPEFQAS NIMHSINGYV FDSLQLSVCL

801 HEVAYWYILS IGAQTDFLSV FFSGYTFKHK MVYEDTLTLF PFSGETVFMS

851 MENPGLWILG CHNSDFRNRG MTALLKVSSC DKNTGDYYED SYEDISAYLL

901 SKNNAIEPRS FSQNPPVLKR HQREITRTTL QGAPGTPGSG TASSSPGASP

951 GTSSTGSPGA SPGTSSTGSP GASPGTSSTG SPGSSPSAST GTGPGTPGSG

1001 TASSSPGASP GTSSTGSPGA SPGTSSTGSP GASPGTSSTG SPGSSTPSGA

1051 TGSPGSSTPS GATGSPGASP GTSSTGSPAS SSDQEEIDYD DTISVEMKKE

1101 DFDIYDEDEN QSPRSFQKKT RHYFIAAVER LWDYGMSSSP HVLRNRAQSG

1151 SVPQFKKVVF QEFTDGSFTQ PLYRGELNEH LGLLGPYIRA EVEDNIMVTF

1201 RNQASRPYSF YSSLISYEED QRQGAEPRKN FVKPNETKTY FWKVQHHMAP

1251 TKDEFDCKAW AYFSDVDLEK DVHSGLIGPL LVCHTNTLNP AHGRQVTVQE

1301 FALFFTIFDE TKSWYFTENM ERNCRGAPTS ESATPESGPG SEPATSGSET

1351 PGTSESATPE SGPGSEPATS GSETPGTSES ATPESGPGTS TEPSEGSAPG
```

```
1401  TSESATPESG PGSPAGSPTS TEEGSPAGSP TSTEEGSPAG SPTSTEEGTS

1451  ESATPESGPG TSTEPSEGSA PGASSAPCNI QMEDPTFKEN YRFHAINGYI

1501  MDTLPGLVMA QDQRIRWYLL SMGSNENIHS IHFSGHVFTV RKKEEYKMAL

1551  YNLYPGVFET VEMLPSKAGI WRVECLIGEH LHAGMSTLFL VYSNKCQTPL

1601  GMASGHIRDF QITASGQYGQ WAPKLARLHY SGSINAWSTK EPFSWIKVDL

1651  LAPMIIHGIK TQGARQKFSS LYISQFIIMY SLDGKKWQTY RGNSTGTLMV

1701  FFGNVDSSGI KHNIFNPPII ARYIRLHPTH YSIRSTLRME LMGCDLNSCS

1751  MPLGMESKAI SDAQITASSY FTNMFATWSP SKARLHLQGR SNAWRPQVNN

1801  PKEWLQVDFQ KTMKVTGVTT QGVKSLLTSM YVKEFLISSS QDGHQWTLFF

1851  QNGKVKVFQG NQDSFTPVVN SLDPPLLTRY LRIHPQSWVH QIALRMEVLG

1901  CEAQDLYDKT HTCPPCPAPE LLGGPSVFLF PPKPKDTLMI SRTPEVTCVV

1951  VDVSHEDPEV KFNWYVDGVE VHNAKTKPRE EQYNSTYRVV SVLTVLHQDW

2001  LNGKEYKCKV SNKALPAPIE KTISKAKGQP REPQVYTLPP SRDELTKNQV

2051  SLTCLVKGFY PSDIAVEWES NGQPENNYKT TPPVLDSDGS FFLYSKLTVD

2101  KSRWQQGNVF SCSVMHEALH NHYTQKSLSL SPGK*
```

FVIII 199 protein sequence (single chain FVIIIFc with three 144 AE XTENs at amino acid 1656 and 1900)

(SEQ ID NO: 75)

```
   1  MQIELSTCFF LCLLRFCFSA TRRYYLGAVE LSWDYMQSDL GELPVDARFP

51  PRVPKSFPFN TSVVYKKTLF VEFTDHLFNI AKPRPPWMGL LGPTIQAEVY

101  DTVVITLKNM ASHPVSLHAV GVSYWKASEG AEYDDQTSQR EKEDDKVFPG

151  GSHTYVWQVL KENGPMASDP LCLTYSYLSH VDLVKDLNSG LIGALLVCRE

201  GSLAKEKTQT LHKFILLFAV FDEGKSWHSE TKNSLMQDRD AASARAWPKM

251  HTVNGYVNRS LPGLIGCHRK SVYWHVIGMG TTPEVHSIFL EGHTFLVRNH

301  RQASLEISPI TFLTAQTLLM DLGQFLLFCH ISSHQHDGME AYVKVDSCPE

351  EPQLRMKNNE EAEDYDDDLT DSEMDVVRFD DDNSPSFIQI RSVAKKHPKT

401  WVHYIAAEEE DWDYAPLVLA PDDRSYKSQY LNNGPQRIGR KYKKVRFMAY

451  TDETFKTREA IQHESGILGP LLYGEVGDTL LIIFKNQASR PYNIYPHGIT

501  DVRPLYSRRL PKGVKHLKDF PILPGEIFKY KWTVTVEDGP TKSDPRCLTR

551  YYSSFVNMER DLASGLIGPL LICYKESVDQ RGNQIMSDKR NVILFSVFDE

601  NRSWYLTENI QRFLPNPAGV QLEDPEFQAS NIMHSINGYV FDSLQLSVCL

651  HEVAYWYILS IGAQTDFLSV FFSGYTFKHK MVYEDTLTLF PFSGETVFMS

701  MENPGLWILG CHNSDFRNRG MTALLKVSSC DKNTGDYYED SYEDISAYLL

751  SKNNAIEPRS FSQNPPVLKR HQAEITRTTL QGAPGTPGSG TASSSPGASP

801  GTSSTGSPGA SPGTSSTGSP GASPGTSSTG SPGSSPSAST GTGPGTPGSG

851  TASSSPGASP GTSSTGSPGA SPGTSSTGSP GASPGTSSTG SPGSSTPSGA

901  TGSPGSSTPS GATGSPGASP GTSSTGSPAS SSDQEEIDYD DTISVEMKKE

951  DFDIYDEDEN QSPRSFQKKT RHYFIAAVER LWDYGMSSSP HVLRNRAQSG

1001  SVPQFKKVVF QEFTDGSFTQ PLYRGELNEH LGLLGPYIRA EVEDNIMVTF

1051  RNQASRPYSF YSSLISYEED QRQGAEPRKN FVKPNETKTY FWKVQHHMAP

1101  TKDEFDCKAW AYFSDVDLEK DVHSGLIGPL LVCHTNTLNP AHGRQVTVQE
```

```
1151  FALFFTIFDE TKSWYFTENM ERNCRGAPTS ESATPESGPG SEPATSGSET

1201  PGTSESATPE SGPGSEPATS GSETPGTSES ATPESGPGTS TEPSEGSAPG

1251  TSESATPESG PGSPAGSPTS TEEGSPAGSP TSTEEGSPAG SPTSTEEGTS

1301  ESATPESGPG TSTEPSEGSA PGASSAPCNI QMEDPTFKEN YRFHAINGYI

1351  MDTLPGLVMA QDQRIRWYLL SMGSNENIHS IHFSGHVFTV RKKEEYKMAL

1401  YNLYPGVFET VEMLPSKAGI WRVECLIGEH LHAGMSTLFL VYSNKCQTPL

1451  GMASGHIRDF QITASGQYGQ WAPKLARLHY SGSINAWSTK EPFSWIKVDL

1501  LAPMIIHGIK TQGARQKFSS LYISQFIIMY SLDGKKWQTY RGNSTGTLMV

1551  FFGNVDSSGI KHNIFNPPII ARYIRLHPTH YSIRSTLRME LMGCDLNSCS

1601  MPLGMESKAI SDAQITASSY FTNMFATWSP SKARLHLQGR SNAWRPQVNN

1651  PKEWLQVDFQ KTMKVTGVTT QGVKSLLTSM YVKEFLISSS QDGHQWTLFF

1701  QNGKVKVFQG NQDSFTPVVN SLDPPLLTRY LRIHPQSWVH QIALRMEVLG

1751  CEAQDLYDKT HTCPPCPAPE LLGGPSVFLF PPKPKDTLMI SRTPEVTCVV

1801  VDVSHEDPEV KFNWYVDGVE VHNAKTKPRE EQYNSTYRVV SVLTVLHQDW

1851  LNGKEYKCKV SNKALPAPIE KTISKAKGQP REPQVYTLPP SRDELTKNQV

1901  SLTCLVKGFY PSDIAVEWES NGQPENNYKT TPPVLDSDGS FFLYSKLTVD

1951  KSRWQQGNVF SCSVMHEALH NHYTQKSLSL SPGK*
```

FVIII 201 protein sequence (single chain FVIIIFc with three 144 AE XTENs at amino acid 26, 1656 & 1900)

(SEQ ID NO: 76)

```
   1  MQIELSTCFF LCLLRFCFSA TRRYYLGAVE LSWDYMQSDL GELPVGAPGS

51  SPSASTGTGP GSSPSASTGT GPGASPGTSS TGSPGASPGT SSTGSPGSST

101  PSGATGSPGS SPSASTGTGP GASPGTSSTG SPGSSPSAST GTGPGTPGSG

151  TASSSPGSST PSGATGSPGS STPSGATGSP GASPGTSSTG SPASSDARFP

201  PRVPKSFPFN TSVVYKKTLF VEFTDHLFNI AKPRPPWMGL LGPTIQAEVY

251  DTVVITLKNM ASHPVSLHAV GVSYWKASEG AEYDDQTSQR EKEDDKVFPG

301  GSHTYVWQVL KENGPMASDP LCLTYSYLSH VDLVKDLNSG LIGALLVCRE

351  GSLAKEKTQT LHKFILLFAV FDEGKSWHSE TKNSLMQDRD AASARAWPKM

401  HTVNGYVNRS LPGLIGCHRK SVYWHVIGMG TTPEVHSIFL EGHTFLVRNH

451  RQASLEISPI TFLTAQTLLM DLGQFLLFCH ISSHQHDGME AYVKVDSCPE

501  EPQLRMKNNE EAEDYDDDLT DSEMDVVRFD DDNSPSFIQI RSVAKKHPKT

551  WVHYIAAEEE DWDYAPLVLA PDDRSYKSQY LNNGPQRIGR KYKKVRFMAY

601  TDETFKTREA IQHESGILGP LLYGEVGDTL LIIFKNQASR PYNIYPHGIT

651  DVRPLYSRRL PKGVKHLKDF PILPGEIFKY KWTVTVEDGP TKSDPRCLTR

701  YYSSFVNMER DLASGLIGPL LICYKESVDQ RGNQIMSDKR NVILFSVFDE

751  NRSWYLTENI QRFLPNPAGV QLEDPEFQAS NIMHSINGYV FDSLQLSVCL

801  HEVAYWYILS IGAQTDFLSV FFSGYTFKHK MVYEDTLTLF PFSGETVFMS

851  MENPGLWILG CHNSDFRNRG MTALLKVSSC DKNTGDYYED SYEDISAYLL

901  SKNNAIEPRS FSQNPPVLKR HQAEITRTTL QGAPGTPGSG TASSSPGASP

951  GTSSTGSPGA SPGTSSTGSP GASPGTSSTG SPGSSPSAST GTGPGTPGSG

1001  TASSSPGASP GTSSTGSPGA SPGTSSTGSP GASPGTSSTG SPGSSTPSGA
```

```
1051  TGSPGSSTPS GATGSPGASP GTSSTGSPAS SSDQEEIDYD DTISVEMKKE

1101  DFDIYDEDEN QSPRSFQKKT RHYFIAAVER LWDYGMSSSP HVLRNRAQSG

1151  SVPQFKKVVF QEFTDGSFTQ PLYRGELNEH LGLLGPYIRA EVEDNIMVTF

1201  RNQASRPYSF YSSLISYEED QRQGAEPRKN FVKPNETKTY FWKVQHHMAP

1251  TKDEFDCKAW AYFSDVDLEK DVHSGLIGPL LVCHTNTLNP AHGRQVTVQE

1301  FALFFTIFDE TKSWYFTENM ERNCRGAPTS ESATPESGPG SEPATSGSET

1351  PGTSESATPE SGPGSEPATS GSETPGTSES ATPESGPGTS TEPSEGSAPG

1401  TSESATPESG PGSPAGSPTS TEEGSPAGSP TSTEEGSPAG SPTSTEEGTS

1451  ESATPESGPG TSTEPSEGSA PGASSAPCNI QMEDPTFKEN YRFHAINGYI

1501  MDTLPGLVMA QDQRIRWYLL SMGSNENIHS IHFSGHVFTV RKKEEYKMAL

1551  YNLYPGVFET VEMLPSKAGI WRVECLIGEH LHAGMSTLFL VYSNKCQTPL

1601  GMASGHIRDF QITASGQYGQ WAPKLARLHY SGSINAWSTK EPFSWIKVDL

1651  LAPMIIHGIK TQGARQKFSS LYISQFIIMY SLDGKKWQTY RGNSTGTLMV

1701  FFGNVDSSGI KHNIFNPPII ARYIRLHPTH YSIRSTLRME LMGCDLNSCS

1751  MPLGMESKAI SDAQITASSY FTNMFATWSP SKARLHLQGR SNAWRPQVNN

1801  PKEWLQVDFQ KTMKVTGVTT QGVKSLLTSM YVKEFLISSS QDGHQWTLFF

1851  QNGKVKVFQG NQDSFTPVVN SLDPPLLTRY LRIHPQSWVH QIALRMEVLG

1901  CEAQDLYDKT HTCPPCPAPE LLGGPSVFLF PPKPKDTLMI SRTPEVTCVV

1951  VDVSHEDPEV KFNWYVDGVE VHNAKTKPRE EQYNSTYRVV SVLTVLHQDW

2001  LNGKEYKCKV SNKALPAPIE KTISKAKGQP REPQVYTLPP SRDELTKNQV

2051  SLTCLVKGFY PSDIAVEWES NGQPENNYKT TPPVLDSDGS FFLYSKLTVD

2101  KSRWQQGNVF SCSVMHEALH NHYTQKSLSL SPGK*
```

FVIII 203 protein sequence (single chain FVIIIFc with two
AE XTENs; one 288AE XTEN in B-domain and one 144 AE XTEN
at amino acid 1900)

(SEQ ID NO: 77)

```
  1  MQIELSTCFF LCLLRFCFSA TRRYYLGAVE LSWDYMQSDL GELPVDARFP

51  PRVPKSFPFN TSVVYKKTLF VEFTDHLFNI AKPRPPWMGL LGPTIQAEVY

101  DTVVITLKNM ASHPVSLHAV GVSYWKASEG AEYDDQTSQR EKEDDKVFPG

151  GSHTYVWQVL KENGPMASDP LCLTYSYLSH VDLVKDLNSG LIGALLVCRE

201  GSLAKEKTQT LHKFILLFAV FDEGKSWHSE TKNSLMQDRD AASARAWPKM

251  HTVNGYVNRS LPGLIGCHRK SVYWHVIGMG TTPEVHSIFL EGHTFLVRNH

301  RQASLEISPI TFLTAQTLLM DLGQFLLFCH ISSHQHDGME AYVKVDSCPE

351  EPQLRMKNNE EAEDYDDDLT DSEMDVVRFD DDNSPSFIQI RSVAKKHPKT

401  WVHYIAAEEE DWDYAPLVLA PDDRSYKSQY LNNGPQRIGR KYKKVRFMAY

451  TDETFKTREA IQHESGILGP LLYGEVGDTL LIIFKNQASR PYNIYPHGIT

501  DVRPLYSRRL PKGVKHLKDF PILPGEIFKY KWTVTVEDGP TKSDPRCLTR

551  YYSSFVNMER DLASGLIGPL LICYKESVDQ RGNQIMSDKR NVILFSVFDE

601  NRSWYL1ENI QRFLPNPAGV QLEDPEFQAS NIMHSINGYV FDSLQLSVCL

651  HEVAYWYILS IGAQTDFLSV FFSGYTFKHK MVYEDTLTLF PFSGETVFMS

701  MENPGLWILG CHNSDFRNRG MTALLKVSSC DKNTGDYYED SYEDISAYLL

751  SKNNAIEPRS FSQNGAPGTS ESATPESGPG SEPATSGSET PGTSESATPE
```

-continued

```
 801  SGPGSEPATS GSETPGTSES ATPESGPGTS TEPSEGSAPG SPAGSPTS1E

851  EGTSESATPE SGPGSEPATS GSETPGTSES ATPESGPGSP AGSPTS1EEG

901  SPAGSPTSTE EGTSTEPSEG SAPGTSESAT PESGPGTSES ATPESGPGTS

951  ESATPESGPG SEPATSGSET PGSEPATSGS ETPGSPAGSP TSTEEGTSTE

1001  PSEGSAPGTS TEPSEGSAPG SEPATSGSET PGTSESATPE SGPGTSTEPS

1051  EGSAPASSPP VLKRHQAEIT RTTLQSDQEE IDYDDTISVE MKKEDFDIYD

1101  EDENQSPRSF QKKTRHYFIA AVERLWDYGM SSSPHVLRNR AQSGSVPQFK

1151  KVVFQEFTDG SFTQPLYRGE LNEHLGLLGP YIRAEVEDNI MVTFRNQASR

1201  PYSFYSSLIS YEEDQRQGAE PRKNFVKPNE TKTYFWKVQH HMAPTKDEFD

1251  CKAWAYFSDV DLEKDVHSGL IGPLLVCHTN TLNPAHGRQV TVQEFALFFT

1301  IFDETKSWYF TENMERNCRG APTSESATPE SGPGSEPATS GSETPGTSES

1351  ATPESGPGSE PATSGSETPG TSESATPESG PGTSTEPSEG SAPGTSESAT

1401  PESGPGSPAG SPTSTEEGSP AGSPTSTEEG SPAGSPTS1E EGTSESATPE

1451  SGPGTSTEPS EGSAPGASSA PCNIQMEDPT FKENYRFHAI NGYIMDTLPG

1501  LVMAQDQRIR WYLLSMGSNE NIHSIHFSGH VFTVRKKEEY KMALYNLYPG

1551  VFETVEMLPS KAGIWRVECL IGEHLHAGMS TLFLVYSNKC QTPLGMASGH

1601  IRDFQITASG QYGQWAPKLA RLHYSGSINA WSTKEPFSWI KVDLLAPMII

1651  HGIKTQGARQ KFSSLYISQF IIMYSLDGKK WQTYRGNSTG TLMVFFGNVD

1701  SSGIKHNIFN PPIIARYIRL HPTHYSIRST LRMELMGCDL NSCSMPLGME

1751  SKAISDAQIT ASSYFTNMFA TWSPSKARLH LQGRSNAWRP QVNNPKEWLQ

1801  VDFQKTMKVT GVTTQGVKSL LTSMYVKEFL ISSSQDGHQW TLFFQNGKVK

1851  VFQGNQDSFT PVVNSLDPPL LTRYLRIHPQ SWVHQIALRM EVLGCEAQDL

1901  YDKTHTCPPC PAPELLGGPS VFLFPPKPKD TLMISRTPEV TCVVVDVSHE

1951  DPEVKFNWYV DGVEVHNAKT KPREEQYNST YRVVSVLTVL HQDWLNGKEY

2001  KCKVSNKALP APIEKTISKA KGQPREPQVY TLPPSRDELT KNQVSLTCLV

2051  KGFYPSDIAV EWESNGQPEN NYKTTPPVLD SDGSFFLYSK LTVDKSRWQQ

2101  GNVFSCSVMH EALHNHYTQK SLSLSPGK*
```

FVIII 204 protein sequence (single chain FVIIIFc with two
AE XTENs; one 288AE XTEN in B-domain and one
144 AE XTEN at amino acid 403)

(SEQ ID NO: 78)

```
   1  MQIELSTCFF LCLLRFCFSA TRRYYLGAVE LSWDYMQSDL GELPVDARFP

51  PRVPKSFPFN TSVVYKKTLF VEFTDHLFNI AKPRPPWMGL LGPTIQAEVY

101  DTVVITLKNM ASHPVSLHAV GVSYWKASEG AEYDDQTSQR EKEDDKVFPG

151  GSHTYVWQVL KENGPMASDP LCLTYSYLSH VDLVKDLNSG LIGALLVCRE

201  GSLAKEKTQT LHKFILLFAV FDEGKSWHSE TKNSLMQDRD AASARAWPKM

251  HTVNGYVNRS LPGLIGCHRK SVYWHVIGMG TTPEVHSIFL EGHTFLVRNH

301  RQASLEISPI TFLTAQTLLM DLGQFLLFCH ISSHQHDGME AYVKVDSCPE

351  EPQLRMKNNE EAEDYDDDLT DSEMDVVRFD DDNSPSFIQI RSVAKKHPKT

401  WVHYIAAEEE DWDYAPLVLA PDDGAPTSTEP SEGSAPGSPA GSPTS1EEGT

451  STEPSEGSAP GTSTEPSEGS APGTSESATP ESGPGTSTEP SEGSAPGTSE
```

-continued

```
 501 SATPESGPGS EPATSGSETP GTSTEPSEGS APGTSTEPSE GSAPGTSESA

551 TPESGPGTSE SATPESGPGA SSDRSYKSQY LNNGPQRIGR KYKKVRFMAY

601 TDETFKTREA IQHESGILGP LLYGEVGDTL LIIFKNQASR PYNIYPHGIT

651 DVRPLYSRRL PKGVKHLKDF PILPGEIFKY KWTVTVEDGP TKSDPRCLTR

701 YYSSFVNMER DLASGLIGPL LICYKESVDQ RGNQIMSDKR NVILFSVFDE

751 NRSWYLTENI QRFLPNPAGV QLEDPEFQAS NIMHSINGYV FDSLQLSVCL

801 HEVAYWYILS IGAQTDFLSV FFSGYTFKHK MVYEDTLTLF PFSGETVFMS

851 MENPGLWILG CHNSDFRNRG MTALLKVSSC DKNTGDYYED SYEDISAYLL

901 SKNNAIEPRS FSQNGAPGTS ESATPESGPG SEPATSGSET PGTSESATPE

951 SGPGSEPATS GSETPGTSES ATPESGPGTS TEPSEGSAPG SPAGSPTSTE

1001 EGTSESATPE SGPGSEPATS GSETPGTSES ATPESGPGSP AGSPTSTLEG

1051 SPAGSPTSTE EGTSTEPSEG SAPGTSESAT PESGPGTSES ATPESGPGTS

1101 ESATPESGPG SEPATSGSET PGSEPATSGS ETPGSPAGSP TSTEEGTSTE

1151 PSEGSAPGTS TEPSEGSAPG SEPATSGSET PGTSESATPE SGPGTSTEPS

1201 EGSAPASSPP VLKRHQAEIT RTTLQSDQEE IDYDDTISVE MKKEDFDIYD

1251 EDENQSPRSF QKKTRHYFIA AVERLWDYGM SSSPHVLRNR AQSGSVPQFK

1301 KVVFQEFTDG SFTQPLYRGE LNEHLGLLGP YIRAEVEDNI MVTFRNQASR

1351 PYSFYSSLIS YEEDQRQGAE PRKNFVKPNE TKTYFWKVQH HMAPTKDEFD

1401 CKAWAYFSDV DLEKDVHSGL IGPLLVCHTN TLNPAHGRQV TVQEFALFFT

1451 IFDETKSWYF TENMERNCRA PCNIQMEDPT FKENYRFHAI NGYIMDTLPG

1501 LVMAQDQRIR WYLLSMGSNE NIHSIHFSGH VFTVRKKEEY KMALYNLYPG

1551 VFETVEMLPS KAGIWRVECL IGEHLHAGMS TLFLVYSNKC QTPLGMASGH

1601 IRDFQITASG QYGQWAPKLA RLHYSGSINA WSTKEPFSWI KVDLLAPMII

1651 HGIKTQGARQ KFSSLYISQF IIMYSLDGKK WQTYRGNSTG TLMVFFGNVD

1701 SSGIKHNIFN PPIIARYIRL HPTHYSIRST LRMELMGCDL NSCSMPLGME

1751 SKAISDAQIT ASSYFTNMFA TWSPSKARLH LQGRSNAWRP QVNNPKEWLQ

1801 VDFQKTMKVT GVTTQGVKSL LTSMYVKEFL ISSSQDGHQW TLFFQNGKVK

1851 VFQGNQDSFT PVVNSLDPPL LTRYLRIHPQ SWVHQIALRM EVLGCEAQDL

1901 YDKTHTCPPC PAPELLGGPS VFLFPPKPKD TLMISRTPEV TCVVVDVSHE

1951 DPEVKFNWYV DGVEVHNAKT KPREEQYNST YRVVSVLTVL HQDWLNGKEY

2001 KCKVSNKALP APIEKTISKA KGQPREPQVY TLPPSRDELT KNQVSLTCLV

2051 KGFYPSDIAV EWESNGQPEN NYKTTPPVLD SDGSFFLYSK LTVDKSRWQQ

2101 GNVFSCSVMH EALHNHYTQK SLSLSPGK*
```

FVIII 205 protein sequence (single chain FVIIIFc with two AE XTENs; one 288AE XTEN in B-domain and one 144 AE XTEN at amino acid 18)

(SEQ ID NO: 79)

```
   1 MQIELSTCFF LCLLRFCFSA TRRYYLGAVE LSWDYMQGAP TSESATPESG

51 PGSEPATSGS ETPGTSESAT PESGPGSEPA TSGSETPGTS ESATPESGPG

101 TSTEPSEGSA PGSPAGSPTS TEEGTSESAT PESGPGSEPA TSGSETPGTS

151 ESATPESGPG SPAGSPTSTE EGSPAGSPTS TEEGASSSDL GELPVDARFP

201 PRVPKSFPFN TSVVYKKTLF VEFTDHLFNI AKPRPPWMGL LGPTIQAEVY
```

```
 251 DTVVITLKNM ASHPVSLHAV GVSYWKASEG AEYDDQTSQR EKEDDKVFPG

301 GSHTYVWQVL KENGPMASDP LCLTYSYLSH VDLVKDLNSG LIGALLVCRE

351 GSLAKEKTQT LHKFILLFAV FDEGKSWHSE TKNSLMQDRD AASARAWPKM

401 HTVNGYVNRS LPGLIGCHRK SVYWHVIGMG TTPEVHSIFL EGHTFLVRNH

451 RQASLEISPI TFLTAQTLLM DLGQFLLFCH ISSHQHDGME AYVKVDSCPE

501 EPQLRMKNNE EAEDYDDDLT DSEMDVVRFD DDNSPSFIQI RSVAKKHPKT

551 WVHYIAAEEE DWDYAPLVLA PDDRSYKSQY LNNGPQRIGR KYKKVRFMAY

601 TDETFKTREA IQHESGILGP LLYGEVGDTL LIIFKNQASR PYNIYPHGIT

651 DVRPLYSRRL PKGVKHLKDF PILPGEIFKY KWTVTVEDGP TKSDPRCLTR

701 YYSSFVNMER DLASGLIGPL LICYKESVDQ RGNQIMSDKR NVILFSVFDE

751 NRSWYLTENI QRFLPNPAGV QLEDPEFQAS NIMHSINGYV FDSLQLSVCL

801 HEVAYWYILS IGAQTDFLSV FFSGYTFKHK MVYEDTLTLF PFSGETVFMS

851 MENPGLWILG CHNSDFRNRG MTALLKVSSC DKNTGDYYED SYEDISAYLL

901 SKNNAIEPRS FSQNGAPGTS ESATPESGPG SEPATSGSET PGTSESATPE

951 SGPGSEPATS GSETPGTSES ATPESGPGTS TEPSEGSAPG SPAGSPTSTE

1001 EGTSESATPE SGPGSEPATS GSETPGTSES ATPESGPGSP AGSPTSTEEG

1051 SPAGSPTSTE EGTSTEPSEG SAPGTSESAT PESGPGTSES ATPESGPGTS

1101 ESATPESGPG SEPATSGSET PGSEPATSGS ETPGSPAGSP TSTEEGTSTE

1151 PSEGSAPGTS TEPSEGSAPG SEPATSGSET PGTSESATPE SGPGTSTEPS

1201 EGSAPASSPP VLKRHQAEIT RTTLQSDQEE IDYDDTISVE MKKEDFDIYD

1251 EDENQSPRSF QKKTRHYFIA AVERLWDYGM SSSPHVLRNR AQSGSVPQFK

1301 KVVFQEFTDG SFTQPLYRGE LNEHLGLLGP YIRAEVEDNI MVTFRNQASR

1351 PYSFYSSLIS YEEDQRQGAE PRKNFVKPNE TKTYFWKVQH HMAPTKDEFD

1401 CKAWAYFSDV DLEKDVHSGL IGPLLVCHTN TLNPAHGRQV TVQEFALFFT

1451 IFDETKSWYF TENMERNCRA PCNIQMEDPT FKENYRFHAI NGYIMDTLPG

1501 LVMAQDQRIR WYLLSMGSNE NIHSIHFSGH VFTVRKKEEY KMALYNLYPG

1551 VFETVEMLPS KAGIWRVECL IGEHLHAGMS TLFLVYSNKC QTPLGMASGH

1601 IRDFQITASG QYGQWAPKLA RLHYSGSINA WSTKEPFSWI KVDLLAPMII

1651 HGIKTQGARQ KFSSLYISQF IIMYSLDGKK WQTYRGNSTG TLMVFFGNVD

1701 SSGIKHNIFN PPIIARYIRL HPTHYSIRST LRMELMGCDL NSCSMPLGME

1751 SKAISDAQIT ASSYFTNMFA TWSPSKARLH LQGRSNAWRP QVNNPKEWLQ

1801 VDFQKTMKVT GVTTQGVKSL LTSMYVKEFL ISSSQDGHQW TLFFQNGKVK

1851 VFQGNQDSFT PVVNSLDPPL LTRYLRIHPQ SWVHQIALRM EVLGCEAQDL

1901 YDKTHTCPPC PAPELLGGPS VFLFPPKPKD TLMISRTPEV TCVVVDVSHE

1951 DPEVKFNWYV DGVEVHNAKT KPREEQYNST YRVVSVLTVL HQDWLNGKEY

2001 KCKVSNKALP APIEKTISKA KGQPREPQVY TLPPSRDELT KNQVSLTCLV

2051 KGFYPSDIAV EWESNGQPEN NYKTTPPVLD SDGSFFLYSK LTVDKSRWQQ

2101 GNVFSCSVMH EALHNHYTQK SLSLSPGK*
``` pSYN FVIII 266 protein sequence (FVIII Fc with 42 AE-XTEN at
amino acid 18 and 288 AE XTEN in B-domain)
SEQ ID NO: 80)

```
   1 MQIELSTCFF LCLLRFCFSA TRRYYLGAVE LSWDYMQGAP GSPAGSPTST

51 EEGTSESATP ESGPGSEPAT SGSETPASSS DLGELPVDAR FPPRVPKSFP

101 FNTSVVYKKT LFVEFTDHLF NIAKPRPPWM GLLGPTIQAE VYDTVVITLK

151 NMASHPVSLH AVGVSYWKAS EGAEYDDQTS QREKEDDKVF PGGSHTYVWQ

201 VLKENGPMAS DPLCLTYSYL SHVDLVKDLN SGLIGALLVC REGSLAKEKT

251 QTLHKFILLF AVFDEGKSWH SETKNSLMQD RDAASARAWP KMHTVNGYVN

301 RSLPGLIGCH RKSVYWHVIG MGTTPEVHSI FLEGHTFLVR NHRQASLEIS

351 PITFLTAQTL LMDLGQFLLF CHISSHQHDG MEAYVKVDSC PEEPQLRMKN

401 NEEAEDYDDD LTDSEMDVVR FDDDNSPSFI QIRSVAKKHP KTWVHYIAAE

451 EEDWDYAPLV LAPDDRSYKS QYLNNGPQRI GRKYKKVRFM AYTDETFKTR

501 EAIQHESGIL GPLLYGEVGD TLLIIFKNQA SRPYNIYPHG ITDVRPLYSR

551 RLPKGVKHLK DFPILPGEIF KYKWTVTVED GPTKSDPRCL TRYYSSFVNM

601 ERDLASGLIG PLLICYKESV DQRGNQIMSD KRNVILFSVF DENRSWYLTE

651 NIQRFLPNPA GVQLEDPEFQ ASNIMHSING YVFDSLQLSV CLHEVAYWYI

701 LSIGAQTDFL SVFFSGYTFK HKMVYEDTLT LFPFSGETVF MSMENPGLWI

751 LGCHNSDFRN RGMTALLKVS SCDKNTGDYY EDSYEDISAY LLSKNNAIEP

801 RSFSQNGAPG TSESATPESG PGSEPATSGS ETPGTSESAT PESGPGSEPA

851 TSGSETPGTS ESATPESGPG TSTEPSEGSA PGSPAGSPTS TEEGTSESAT

901 PESGPGSEPA TSGSETPGTS ESATPESGPG SPAGSPTSTE EGSPAGSPTS

951 TEEGTSTEPS EGSAPGTSES ATPESGPGTS ESATPESGPG TSESATPESG

1001 PGSEPATSGS ETPGSEPATS GSETPGSPAG SPTSTEEGTS TEPSEGSAPG

1051 TSTEPSEGSA PGSEPATSGS ETPGTSESAT PESGPGTSIF PSEGSAPASS

1101 PPVLKRHQAE ITRTTLQSDQ EEIDYDDTIS VEMKKEDFDI YDEDENQSPR

1151 SFQKKTRHYF IAAVERLWDY GMSSSPHVLR NRAQSGSVPQ FKKVVFQEFT

1201 DGSFTQPLYR GELNEHLGLL GPYIRAEVED NIMVTFRNQA SRPYSFYSSL

1251 ISYEEDQRQG AEPRKNFVKP NETKTYFWKV QHHMAPTKDE FDCKAWAYFS

1301 DVDLEKDVHS GLIGPLLVCH TNTLNPAHGR QVTVQEFALF FTIFDETKSW

1351 YFTENMERNC RAPCNIQMED PTFKENYRFH AINGYIMDTL PGLVMAQDQR

1401 IRWYLLSMGS NENIHSIHFS GHVFTVRKKE EYKMALYNLY PGVFETVEML

1451 PSKAGIWRVE CLIGEHLHAG MSTLFLVYSN KCQTPLGMAS GHIRDFQITA

1501 SGQYGQWAPK LARLHYSGSI NAWSTKEPFS WIKVDLLAPM IIHGIKTQGA

1551 RQKFSSLYIS QFIIMYSLDG KKWQTYRGNS TGTLMVFFGN VDSSGIKHNI

1601 FNPPIIARYI RLHPTHYSIR STLRMELMGC DLNSCSMPLG MESKAISDAQ

1651 ITASSYFTNM FATWSPSKAR LHLQGRSNAW RPQVNNPKEW LQVDFQKTMK

1701 VTGVTTQGVK SLLTSMYVKE FLISSSQDGH QWTLFFQNGK VKVFQGNQDS

1751 FTPVVNSLDP PLLTRYLRIH PQSWVHQIAL RMEVLGCEAQ DLYDKTHTCP

1801 PCPAPELLGG PSVFLFPPKP KDTLMISRTP EVTCVVVDVS HEDPEVKFNW

1851 YVDGVEVHNA KTKPREEQYN STYRVVSVLT VLHQDWLNGK EYKCKVSNKA
```

```
1901  LPAPIEKTIS KAKGQPREPQ VYTLPPSRDE LTKNQVSLTC LVKGFYPSDI

1951  AVEWESNGQP ENNYKTTPPV LDSDGSFFLY SKLTVDKSRW QQGNVFSCSV

2001  MHEALHNHYT QKSLSLSPGK *
``` pSYN FVIII 267 protein sequence (FVIII Fc with 72 AE-XTEN at amino acid 18 and 288 AE XTEN in B-domain)

SEQ ID NO: 81)

```
   1  MQIELSTCFF LCLLRFCFSA TRRYYLGAVE LSWDYMQGAP TSESATPESG

51  PGSEPATSGS ETPGTSESAT PESGPGSEPA TSGSETPGTS ESATPESGPG

101  TSTEPSEGSA PGASSSDLGE LPVDARFPPR VPKSFPFNTS VVYKKTLFVE

151  FTDHLFNIAK PRPPWMGLLG PTIQAEVYDT VVITLKNMAS HPVSLHAVGV

201  SYWKASEGAE YDDQTSQREK EDDKVFPGGS HTYVWQVLKE NGPMASDPLC

251  LTYSYLSHVD LVKDLNSGLI GALLVCREGS LAKEKTQTLH KFILLFAVFD

301  EGKSWHSETK NSLMQDRDAA SARAWPKMHT VNGYVNRSLP GLIGCHRKSV

351  YWHVIGMGTT PEVHSIFLEG HTFLVRNHRQ ASLEISPITF LTAQTLLMDL

401  GQFLLFCHIS SHQHDGMEAY VKVDSCPEEP QLRMKNNEEA EDYDDDLTDS

451  EMDVVRFDDD NSPSFIQIRS VAKKHPKTWV HYIAAEEEDW DYAPLVLAPD

501  DRSYKSQYLN NGPQRIGRKY KKVRFMAYTD ETFKTREAIQ HESGILGPLL

551  YGEVGDTLLI IFKNQASRPY NIYPHGITDV RPLYSRRLPK GVKHLKDFPI

601  LPGEIFKYKW TVTVEDGPTK SDPRCLTRYY SSFVNMERDL ASGLIGPLLI

651  CYKESVDQRG NQIMSDKRNV ILFSVFDENR SWYLTENIQR FLPNPAGVQL

701  EDPEFQASNI MHSINGYVFD SLQLSVCLHE VAYWYILSIG AQTDFLSVFF

751  SGYTFKHKMV YEDTLTLFPF SGETVFMSME NPGLWILGCH NSDFRNRGMT

801  ALLKVSSCDK NTGDYYEDSY EDISAYLLSK NNAIEPRSFS QNGAPGTSES

851  ATPESGPGSE PATSGSETPG TSESATPESG PGSEPATSGS ETPGTSESAT

901  PESGPGTSTE PSEGSAPGSP AGSPTSTEEG TSESATPESG PGSEPATSGS

951  ETPGTSESAT PESGPGSPAG SPTSTEEGSP AGSPTSTEEG TSTEPSEGSA

1001  PGTSESATPE SGPGTSESAT PESGPGTSES ATPESGPGSE PATSGSETPG

1051  SEPATSGSET PGSPAGSPTS TEEGTSTEPS EGSAPGTSTF PSEGSAPGSE

1101  PATSGSETPG TSESATPESG PGTSIEPSEG SAPASSPPVL KRHQAEITRT

1151  TLQSDQEEID YDDTISVEMK KEDFDIYDED ENQSPRSFQK KTRHYFIAAV

1201  ERLWDYGMSS SPHVLRNRAQ SGSVPQFKKV VFQEFTDGSF TQPLYRGELN

1251  EHLGLLGPYI RAEVEDNIMV TFRNQASRPY SFYSSLISYE EDQRQGAEPR

1301  KNFVKPNETK TYFWKVQHHM APTKDEFDCK AWAYFSDVDL EKDVHSGLIG

1351  PLLVCHTNTL NPAHGRQVTV QEFALFFTIF DETKSWYFTE NMERNCRAPC

1401  NIQMEDPTFK ENYRFHAING YIMDTLPGLV MAQDQRIRWY LLSMGSNENI

1451  HSIHFSGHVF TVRKKEEYKM ALYNLYPGVF ETVEMLPSKA GIWRVECLIG

1501  EHLHAGMSTL FLVYSNKCQT PLGMASGHIR DFQITASGQY GQWAPKLARL

1551  HYSGSINAWS TKEPFSWIKV DLLAPMIIHG IKTQGARQKF SSLYISQFII

1601  MYSLDGKKWQ TYRGNSTGTL MVFFGNVDSS GIKHNIFNPP IIARYIRLHP

1651  THYSIRSTLR MELMGCDLNS CSMPLGMESK AISDAQITAS SYFTNMFATW

1701  SPSKARLHLQ GRSNAWRPQV NNPKEWLQVD FQKTMKVTGV TTQGVKSLLT
```

```
1751  SMYVKEFLIS SSQDGHQWTL FFQNGKVKVF QGNQDSFTPV VNSLDPPLLT

1801  RYLRIHPQSW VHQIALRMEV LGCEAQDLYD KTHTCPPCPA PELLGGPSVF

1851  LFPPKPKDTL MISRTPEVTC VVVDVSHEDP EVKFNWYVDG VEVHNAKTKP

1901  REEQYNSTYR VVSVLTVLHQ DWLNGKEYKC KVSNKALPAP IEKTISKAKG

1951  QPREPQVYTL PPSRDELTKN QVSLTCLVKG FYPSDIAVEW ESNGQPENNY

2001  KTTPPVLDSD GSFFLYSKLT VDKSRWQQGN VFSCSVMHEA LHNHYTQKSL

2051  SLSPGK*
``` pSYN FVIII 268 protein sequence (FYIII Fc with 144 AE-XTEN at amino acid 18)

SEQ ID NO: 82)

```
   1  MQIELSTCFF LCLLRFCFSA TRRYYLGAVE LSWDYMQGAP TSESATPESG

51  PGSEPATSGS ETPGTSESAT PESGPGSEPA TSGSETPGTS ESATPESGPG

101  TSTEPSEGSA PGSPAGSPTS TEEGTSESAT PESGPGSEPA TSGSETPGTS

151  ESATPESGPG SPAGSPTSTE EGSPAGSPTS 1EEGASSSDL GELPVDARFP

201  PRVPKSFPFN TSVVYKKTLF VEFTDHLFNI AKPRPPWMGL LGPTIQAEVY

251  DTVVITLKNM ASHPVSLHAV GVSYWKASEG AEYDDQTSQR EKEDDKVFPG

301  GSHTYVWQVL KENGPMASDP LCLTYSYLSH VDLVKDLNSG LIGALLVCRE

351  GSLAKEKTQT LHKFILLFAV FDEGKSWHSE TKNSLMQDRD AASARAWPKM

401  HTVNGYVNRS LPGLIGCHRK SVYWHVIGMG TTPEVHSIFL EGHTFLVRNH

451  RQASLEISPI TFLTAQTLLM DLGQFLLFCH ISSHQHDGME AYVKVDSCPE

501  EPQLRMKNNE EAEDYDDDLT DSEMDVVRFD DDNSPSFIQI RSVAKKHPKT

551  WVHYIAAEEE DWDYAPLVLA PDDRSYKSQY LNNGPQRIGR KYKKVRFMAY

601  TDETFKTREA IQHESGILGP LLYGEVGDTL LIIFKNQASR PYNIYPHGIT

651  DVRPLYSRRL PKGVKHLKDF PILPGEIFKY KWTVTVEDGP TKSDPRCLTR

701  YYSSFVNMER DLASGLIGPL LICYKESVDQ RGNQIMSDKR NVILFSVFDE

751  NRSWYLTENI QRFLPNPAGV QLEDPEFQAS NIMHSINGYV FDSLQLSVCL

801  HEVAYWYILS IGAQTDFLSV FFSGYTFKHK MVYEDTLTLF PFSGETVFMS

851  MENPGLWILG CHNSDFRNRG MTALLKVSSC DKNTGDYYED SYEDISAYLL

901  SKNNAIEPRS FSQNPPVLKR HQAEITRTTL QSDQEEIDYD DTISVEMKKE

951  DFDIYDEDEN QSPRSFQKKT RHYFIAAVER LWDYGMSSSP HVLRNRAQSG

1001  SVPQFKKVVF QEFTDGSFTQ PLYRGELNEH LGLLGPYIRA EVEDNIMVTF

1051  RNQASRPYSF YSSLISYEED QRQGAEPRKN FVKPNETKTY FWKVQHHMAP

1101  TKDEFDCKAW AYFSDVDLEK DVHSGLIGPL LVCHTNTLNP AHGRQVTVQE

1151  FALFFTIFDE TKSWYFTENM ERNCRAPCNI QMEDPTFKEN YRFHAINGYI

1201  MDTLPGLVMA QDQRIRWYLL SMGSNENIHS IHFSGHVFTV RKKEEYKMAL

1251  YNLYPGVFET VEMLPSKAGI WRVECLIGEH LHAGMSTLFL VYSNKCQTPL

1301  GMASGHIRDF QITASGQYGQ WAPKLARLHY SGSINAWSTK EPFSWIKVDL

1351  LAPMIIHGIK TQGARQKFSS LYISQFIIMY SLDGKKWQTY RGNSTGTLMV

1401  FFGNVDSSGI KHNIFNPPII ARYIRLHPTH YSIRSTLRME LMGCDLNSCS

1451  MPLGMESKAI SDAQITASSY FTNMFATWSP SKARLHLQGR SNAWRPQVNN

1501  PKEWLQVDFQ KTMKVTGVTT QGVKSLLTSM YVKEFLISSS QDGHQWTLFF
```

```
1551 QNGKVKVFQG NQDSFTPVVN SLDPPLLTRY LRIHPQSWVH QIALRMEVLG

1601 CEAQDLYDKT HTCPPCPAPE LLGGPSVFLF PPKPKDTLMI SRTPEVTCVV

1651 VDVSHEDPEV KFNWYVDGVE VHNAKTKPRE EQYNSTYRVV SVLTVLHQDW

1701 LNGKEYKCKV SNKALPAPIE KTISKAKGQP REPQVYTLPP SRDELTKNQV

1751 SLTCLVKGFY PSDIAVEWES NGQPENNYKT TPPVLDSDGS FFLYSKLTVD

1801 KSRWQQGNVF SCSVMHEALH NHYTQKSLSL SPGK*
``` pSYN FVIII 269 protein sequence (FVIII Fc with 72 AE-
XTEN at amino acid 18)
(SEQ ID NO: 83)

```
   1 MQIELSTCFF LCLLRFCFSA TRRYYLGAVE LSWDYMQGAP TSESATPESG

51 PGSEPATSGS ETPGTSESAT PESGPGSEPA TSGSETPGTS ESATPESGPG

101 TSTEPSEGSA PGASSSDLGE LPVDARFPPR VPKSFPFNTS VVYKKTLFVE

151 FTDHLFNIAK PRPPWMGLLG PTIQAEVYDT VVITLKNMAS HPVSLHAVGV

201 SYWKASEGAE YDDQTSQREK EDDKVFPGGS HTYVWQVLKE NGPMASDPLC

251 LTYSYLSHVD LVKDLNSGLI GALLVCREGS LAKEKTQTLH KFILLFAVFD

301 EGKSWHSETK NSLMQDRDAA SARAWPKMHT VNGYVNRSLP GLIGCHRKSV

351 YWHVIGMGTT PEVHSIFLEG HTFLVRNHRQ ASLEISPITF LTAQTLLMDL

401 GQFLLFCHIS SHQHDGMEAY VKVDSCPEEP QLRMKNNEEA EDYDDDLTDS

451 EMDVVRFDDD NSPSFIQIRS VAKKHPKTWV HYIAAEEEDW DYAPLVLAPD

501 DRSYKSQYLN NGPQRIGRKY KKVRFMAYTD ETFKTREAIQ HESGILGPLL

551 YGEVGDTLLI IFKNQASRPY NIYPHGITDV RPLYSRRLPK GVKHLKDFPI

601 LPGEIFKYKW TVTVEDGPTK SDPRCLTRYY SSFVNMERDL ASGLIGPLLI

651 CYKESVDQRG NQIMSDKRNV ILFSVFDENR SWYLTENIQR FLPNPAGVQL

701 EDPEFQASNI MHSINGYVFD SLQLSVCLHE VAYWYILSIG AQTDFLSVFF

751 SGYTFKHKMV YEDTLTLFPF SGETVFMSME NPGLWILGCH NSDFRNRGMT

801 ALLKVSSCDK NTGDYYEDSY EDISAYLLSK NNAIEPRSFS QNPPVLKRHQ

851 AEITRTTLQS DQEEIDYDDT ISVEMKKEDF DIYDEDENQS PRSFQKKTRH

901 YFIAAVERLW DYGMSSSPHV LRNRAQSGSV PQFKKVVFQE FTDGSFTQPL

951 YRGELNEHLG LLGPYIRAEV EDNIMVTFRN QASRPYSFYS SLISYEEDQR

1001 QGAEPRKNFV KPNETKTYFW KVQHHMAPTK DEFDCKAWAY FSDVDLEKDV

1051 HSGLIGPLLV CHTNTLNPAH GRQVTVQEFA LFFTIFDETK SWYFTENMER

1101 NCRAPCNIQM EDPTFKENYR FHAINGYIMD TLPGLVMAQD QRIRWYLLSM

1151 GSNENIHSIH FSGHVFTVRK KEEYKMALYN LYPGVFETVE MLPSKAGIWR

1201 VECLIGEHLH AGMSTLFLVY SNKCQTPLGM ASGHIRDFQI TASGQYGQWA

1251 PKLARLHYSG SINAWSTKEP FSWIKVDLLA PMIIHGIKTQ GARQKFSSLY

1301 ISQFIIMYSL DGKKWQTYRG NSTGTLMVFF GNVDSSGIKH NIFNPPIIAR

1351 YIRLHPTHYS IRSTLRMELM GCDLNSCSMP LGMESKAISD AQITASSYFT

1401 NMFATWSPSK ARLHLQGRSN AWRPQVNNPK EWLQVDFQKT MKVTGVTTQG

1451 VKSLLTSMYV KEFLISSSQD GHQWTLFFQN GKVKVFQGNQ DSFTPVVNSL

1501 DPPLLTRYLR IHPQSWVHQI ALRMEVLGCE AQDLYDKTHT CPPCPAPELL

1551 GGPSVFLFPP KPKDTLMISR TPEVTCVVVD VSHEDPEVKF NWYVDGVEVH
```

```
1601 NAKTKPREEQ YNSTYRVVSV LTVLHQDWLN GKEYKCKVSN KALPAPIEKT

1651 ISKAKGQPRE PQVYTLPPSR DELTKNQVSL TCLVKGFYPS DIAVEWESNG

1701 QPENNYKTTP PVLDSDGSFF LYSKLTVDKS RWQQGNVFSC SVMHEALHNH

1751 YTQKSLSLSP GK*
``` pSYNFVIII 271 protein sequence (FVIII Fc with 42 AE-XTEN at amino acid 18)
SEQ ID NO: 84)

```
   1 MQIELSTCFF LCLLRFCFSA TRRYYLGAVE LSWDYMQGAP GSPAGSPTST

51 EEGTSESATP ESGPGSEPAT SGSETPASSS DLGELPVDAR FPPRVPKSFP

101 FNTSVVYKKT LFVEFTDHLF NIAKPRPPWM GLLGPTIQAE VYDTVVITLK

151 NMASHPVSLH AVGVSYWKAS EGAEYDDQTS QREKEDDKVF PGGSHTYVWQ

201 VLKENGPMAS DPLCLTYSYL SHVDLVKDLN SGLIGALLVC REGSLAKEKT

251 QTLHKFILLF AVFDEGKSWH SETKNSLMQD RDAASARAWP KMHTVNGYVN

301 RSLPGLIGCH RKSVYWHVIG MGTTPEVHSI FLEGHTFLVR NHRQASLEIS

351 PITFLTAQTL LMDLGQFLLF CHISSHQHDG MEAYVKVDSC PEEPQLRMKN

401 NEEAEDYDDD LTDSEMDVVR FDDDNSPSFI QIRSVAKKHP KTWVHYIAAE

451 EEDWDYAPLV LAPDDRSYKS QYLNNGPQRI GRKYKKVRFM AYTDETFKTR

501 EAIQHESGIL GPLLYGEVGD TLLIIFKNQA SRPYNIYPHG ITDVRPLYSR

551 RLPKGVKHLK DFPILPGEIF KYKWTVTVED GPTKSDPRCL TRYYSSFVNM

601 ERDLASGLIG PLLICYKESV DQRGNQIMSD KRNVILFSVF DENRSWYLTE

651 NIQRFLPNPA GVQLEDPEFQ ASNIMHSING YVFDSLQLSV CLHEVAYWYI

701 LSIGAQTDFL SVFFSGYTFK HKMVYEDTLT LFPFSGETVF MSMENPGLWI

751 LGCHNSDFRN RGMTALLKVS SCDKNTGDYY EDSYEDISAY LLSKNNAIEP

801 RSFSQNPPVL KRHQAEITRT TLQSDQEEID YDDTISVEMK KEDFDIYDED

851 ENQSPRSFQK KTRHYFIAAV ERLWDYGMSS SPHVLRNRAQ SGSVPQFKKV

901 VFQEFTDGSF TQPLYRGELN EHLGLLGPYI RAEVEDNIMV TFRNQASRPY

951 SFYSSLISYE EDQRQGAEPR KNFVKPNETK TYFWKVQHHM APTKDEFDCK

1001 AWAYFSDVDL EKDVHSGLIG PLLVCHTNTL NPAHGRQVTV QEFALFFTIF

1051 DETKSWYFTE NMERNCRAPC NIQMEDPTFK ENYRFHAING YIMDTLPGLV

1101 MAQDQRIRWY LLSMGSNENI HSIHFSGHVF TVRKKEEYKM ALYNLYPGVF

1151 ETVEMLPSKA GIWRVECLIG EHLHAGMSTL FLVYSNKCQT PLGMASGHIR

1201 DFQITASGQY GQWAPKLARL HYSGSINAWS TKEPFSWIKV DLLAPMIIHG

1251 IKTQGARQKF SSLYISQFII MYSLDGKKWQ TYRGNSTGTL MVFFGNVDSS

1301 GIKHNIFNPP IIARYIRLHP THYSIRSTLR MELMGCDLNS CSMPLGMESK

1351 AISDAQITAS SYFTNMFATW SPSKARLHLQ GRSNAWRPQV NNPKEWLQVD

1401 FQKTMKVTGV TTQGVKSLLT SMYVKEFLIS SSQDGHQWTL FFQNGKVKVF

1451 QGNQDSFTPV VNSLDPPLLT RYLRIHPQSW VHQIALRMEV LGCEAQDLYD

1501 KTHTCPPCPA PELLGGPSVF LFPPKPKDTL MISRTPEVTC VVVDVSHEDP

1551 EVKFNWYVDG VEVHNAKTKP REEQYNSTYR VVSVLTVLHQ DWLNGKEYKC

1601 KVSNKALPAP IEKTISKAKG QPREPQVYTL PPSRDELTKN QVSLTCLVKG

1651 FYPSDIAVEW ESNGQPENNY KTTPPVLDSD GSFFLYSKLT VDKSRWQQGN

1701 VFSCSVMHEA LHNHYTQKSL SLSPGK*
```

-continued pSYN FVIII protein sequence 272 (FVIII with 144 AE XTEN at
amino acid 18 and 244 AE XTEN in B-domain-no Fc)
SEQ ID NO: 85)

```
   1 MQIELSTCFF LCLLRFCFSA TRRYYLGAVE LSWDYMQGAP TSESATPESG

51 PGSEPATSGS ETPGTSESAT PESGPGSEPA TSGSETPGTS ESATPESGPG

101 TSTEPSEGSA PGSPAGSPTS TEEGTSESAT PESGPGSEPA TSGSETPGTS

151 ESATPESGPG SPAGSPTSTE EGSPAGSPTS lEEGASSSDL GELPVDARFP

201 PRVPKSFPFN TSVVYKKTLF VEFTDHLFNI AKPRPPWMGL LGPTIQAEVY

251 DTVVITLKNM ASHPVSLHAV GVSYWKASEG AEYDDQTSQR EKEDDKVFPG

301 GSHTYVWQVL KENGPMASDP LCLTYSYLSH VDLVKDLNSG LIGALLVCRE

351 GSLAKEKTQT LHKFILLFAV FDEGKSWHSE TKNSLMQDRD AASARAWPKM

401 HTVNGYVNRS LPGLIGCHRK SVYWHVIGMG TTPEVHSIFL EGHTFLVRNH

451 RQASLEISPI TFLTAQTLLM DLGQFLLFCH ISSHQHDGME AYVKVDSCPE

501 EPQLRMKNNE EAEDYDDDLT DSEMDVVRFD DDNSPSFIQI RSVAKKHPKT

551 WVHYIAAEEE DWDYAPLVLA PDDRSYKSQY LNNGPQRIGR KYKKVRFMAY

601 TDETFKTREA IQHESGILGP LLYGEVGDTL LIIFKNQASR PYNIYPHGIT

651 DVRPLYSRRL PKGVKHLKDF PILPGEIFKY KWTVTVEDGP TKSDPRCLTR

701 YYSSFVNMER DLASGLIGPL LICYKESVDQ RGNQIMSDKR NVILFSVFDE

751 NRSWYLTENI QRFLPNPAGV QLEDPEFQAS NIMHSINGYV FDSLQLSVCL

801 HEVAYWYILS IGAQTDFLSV FFSGYTFKHK MVYEDTLTLF PFSGETVFMS

851 MENPGLWILG CHNSDFRNRG MTALLKVSSC DKNTGDYYED SYEDISAYLL

901 SKNNAIEPRS FSQNGAPGTS ESATPESGPG SEPATSGSET PGTSESATPE

951 SGPGSEPATS GSETPGTSES ATPESGPGTS TEPSEGSAPG SPAGSPTSTE

1001 EGTSESATPE SGPGSEPATS GSETPGTSES ATPESGPGSP AGSPTSTEEG

1051 SPAGSPTSTE EGTSTEPSEG SAPGTSESAT PESGPGTSES ATPESGPGTS

1101 ESATPESGPG SEPATSGSET PGSEPATSGS ETPGSPAGSP TSTEEGTSTE

1151 PSEGSAPGTS lEPSEGSAPG SEPATSGSET PGTSESATPE SGPGTSTEPS

1201 EGSAPASSPP VLKRHQAEIT RTTLQSDQEE IDYDDTISVE MKKEDFDIYD

1251 EDENQSPRSF QKKTRHYFIA AVERLWDYGM SSSPHVLRNR AQSGSVPQFK

1301 KVVFQEFTDG SFTQPLYRGE LNEHLGLLGP YIRAEVEDNI MVTFRNQASR

1351 PYSFYSSLIS YEEDQRQGAE PRKNFVKPNE TKTYFWKVQH HMAPTKDEFD

1401 CKAWAYFSDV DLEKDVHSGL IGPLLVCH1N TLNPAHGRQV TVQEFALFFT

1451 IFDETKSWYF TENMERNCRA PCNIQMEDPT FKENYRFHAI NGYIMDTLPG

1501 LVMAQDQRIR WYLLSMGSNE NIHSIHFSGH VFTVRKKEEY KMALYNLYPG

1551 VFETVEMLPS KAGIWRVECL IGEHLHAGMS TLFLVYSNKC QTPLGMASGH

1601 IRDFQITASG QYGQWAPKLA RLHYSGSINA WSTKEPFSWI KVDLLAPMII

1651 HGIKTQGARQ KFSSLYISQF IIMYSLDGKK WQTYRGNSTG TLMVFFGNVD

1701 SSGIKHNIFN PPIIARYIRL HPTHYSIRST LRMELMGCDL NSCSMPLGME

1751 SKAISDAQIT ASSYFTNMFA TWSPSKARLH LQGRSNAWRP QVNNPKEWLQ
```

```
1801  VDFQKTMKVT GVTTQGVKSL LTSMYVKEFL ISSSQDGHQW TLFFQNGKVK

1851  VFQGNQDSFT PVVNSLDPPL LTRYLRIHPQ SWVHQIALRM EVLGCEAQDL

1901  Y*
``` pSYN-FVIII-161 protein sequence
(FVIII sequence amino acid position 1-1457;
underlined region represents Fc region; curvy underline
represents cleavable linker in between first Fc
and VWF fragment; double underlined region
represents VWF fragment; bold region represents
cleavable linker in between VWF fragment and Fc).

(SEQ ID NO: 69)
```
   1  MQIELSTCFF LCLLRFCFSA TRRYYLGAVE LSWDYMQSDL GELPVDARFP

51  PRVPKSFPFN TSVVYKKTLF VEFTDHLFNI AKPRPPWMGL LGPTIQAEVY

101  DTVVITLKNM ASHPVSLHAV GVSYWKASEG AEYDDQTSQR EKEDDKVFPG

151  GSHTYVWQVL KENGPMASDP LCLTYSYLSH VDLVKDLNSG LIGALLVCRE

201  GSLAKEKTQT LHKFILLFAV FDEGKSWHSE TKNSLMQDRD AASARAWPKM

251  HTVNGYVNRS LPGLIGCHRK SVYWHVIGMG TTPEVHSIFL EGHTFLVRNH

301  RQASLEISPI TFLTAQTLLM DLGQFLLFCH ISSHQHDGME AYVKVDSCPE

351  EPQLRMKNNE EAEDYDDDLT DSEMDVVRFD DDNSPSFIQI RSVAKKHPKT

401  WVHYIAAEEE DWDYAPLVLA PDDRSYKSQY LNNGPQRIGR KYKKVRFMAY

451  TDETFKTREA IQHESGILGP LLYGEVGDTL LIIFKNQASR PYNIYPHGIT

501  DVRPLYSRRL PKGVKHLKDF PILPGEIFKY KWTVTVEDGP TKSDPRCLTR

551  YYSSFVNMER DLASGLIGPL LICYKESVDQ RGNQIMSDKR NVILFSVFDE

601  NRSWYL 1ENI QRFLPNPAGV QLEDPEFQAS NIMHSINGYV FDSLQLSVCL

651  HEVAYWYILS IGAQTDFLSV FFSGYTFKHK MVYEDTLTLF PFSGETVFMS

701  MENPGLWILG CHNSDFRNRG MTALLKVS SC DKNTGDYYED SYEDISAYLL

751  SKNNAIEPRS FSQNPPVLKR HQREITRTTL QSDQEEIDYD DTISVEMKKE

801  DFDIYDEDEN QSPRSFQKKT RHYFIAAVER LWDYGMSSSP HVLRNRAQSG

851  SVPQFKKVVF QEFTDGSFTQ PLYRGELNEH LGLLGPYIRA EVEDNIMVTF

901  RNQASRPYSF YSSLISYEED QRQGAEPRKN FVKPNETKTY FWKVQHHMAP

951  TKDEFDCKAW AYFSDVDLEK DVHSGLIGPL LVCHTNTLNP AHGRQVTVQE

1001  FALFFTIFDE TKSWYF 1ENM ERNCRAPCNI QMEDPTFKEN YRFHAINGYI

1051  MDTLPGLVMA QDQRIRWYLL SMGSNENIHS IHFSGHVFTV RKKEEYKMAL

1101  YNLYPGVFET VEMLPSKAGI WRVECLIGEH LHAGMSTLFL VYSNKCQTPL

1151  GMASGHIRDF QITASGQYGQ WAPKLARLHY SGSINAWSTK EPFSWIKVDL

1201  LAPMIIHGIK TQGARQKFSS LYISQFIIMY SLDGKKWQTY RGNSTGTLMV

1251  FFGNVDSSGI KHNIFNPPII ARYIRLHPTH YSIRSTLRME LMGCDLNSCS

1301  MPLGMESKAI SDAQITASSY FTNMFATWSP SKARLHLQGR SNAWRPQVNN

1351  PKEWLQVDFQ KTMKVTGVTT QGVKSLLTSM YVKEFLISSS QDGHQWTLFF

1401  QNGKVKVFQG NQDSFTPVVN SLDPPLLTRY LRIHPQSWVH QIALRMEVLG

1451  CEAQDLYDKT HTCPPCPAPE LLGGPSVFLF PPKPKDTLMI SRTPEVTCVV

1501  VDVSHEDPEV KFNWYVDGVE VHNAKTKPRE EQYNSTYRVV SVLTVLHQDW

1551  LNGKEYKCKV SNKALPAPIE KTISKAKGQP REPQVYTLPP SRDELTKNQV
```

```
1601  SLTCLVKGFY PSDIAVEWES NGQPENNYKT TPPVLDSDGS FFLYSKLTVD

1651  KSRWQQGNVF SCSVMHEALH NHYTQKSLSL SPGKRRRRSG GGGSGGGGSG

1701  GGGSGGGGSG GGGSGGGGSR KRRKRSLSCR PPMVKLVCPA DNLRAEGLEC

1751  TKTCQNYDLE CMSMGCVSGC LCPPGMVRHE NRCVALERCP CFHQGKEYAP

1801  GETVKIGCNT CVCRDRKWNC TDHVCDATCS TIGMAHYLTF DGLKYLFPGE

1851  CQYVLVQDYC GSNPGTFRIL VGNKGCSHPS VKCKKRVTIL VEGGEIELFD

1901  GEVNVKRPMK DETHFEVVES GRYIILLLGK ALSVVWDRHL SISVVLKQTY

1951  QEKVCGLCGN FDGIQNNDLT SSNLQVEEDP VDFGNSWKVS SQCADTRKVP

2001  LDSSPATCHN NIMKQTMVDS SCRILTSDVF QDCNKLVDPE PYLDVCIYDT

2051  CSCESIGDCA AFCDTIAAYA HVCAQHGKVV TWRTATLCPQ SCEERNLREN

2101  GYEAEWRYNS CAPACQVTCQ HPEPLACPVQ CVEGCHAHCP PGKILDELLQ

2151  TCVDPEDCPV CEVAGRRFAS GKKVTLNPSD PEHCQICHCD VVNLTCEACQ

2201  EPISGTSESA TPESGPGSEP ATSGSETPGT SESATPESGP GSEPATSGSE

2251  TPGTSESATP ESGPGTSTEP SEGSAPGSPA GSPTSTEEGT SESATPESGP

2301  GSEPATSGSE TPGTSESATP ESGPGSPAGS PTSTEEGSPA GSPTSTEEGT

2351  STEPSEGSAP GTSESATPES GPGTSESATP ESGPGTSESA TPESGPGSEP

2401  ATSGSETPGS EPATSGSETP GSPAGSPTST EEGTSTEPSE GSAPGTSTEP

2451  SEGSAPGSEP ATSGSETPGT SESATPESGP GTSTEPSEGS APDSGGGGSG

2501  GGGSGGGGSG GGGSGGGGSL VPRGSGGDKT HTCPPCPAPE LLGGPSVFLF

2551  PPKPKDTLMI SRTPEVTCVV VDVSHEDPEV KFNWYVDGVE VHNAKTKPRE

2601  EQYNSTYRVV SVLTVLHQDW LNGKEYKCKV SNKALPAPIE KTISKAKGQP

2651  REPQVYTLPP SRDELTKNQV SLTCLVKGFY PSDIAVEWES NGQPENNYKT

2701  TPPVLDSDGS FFLYSKLTVD KSRWQQGNVF SCSVMHEALH NHYTQKSLSL

2751  SPGK
``` pSYN-FVIII-170 protein sequence
(SEQ ID NO: 71)

```
  1  SLSCRPPMVK LVCPADNLRA EGLECTKTCQ NYDLECMSMG CVSGCLCPPG

51  MVRHENRCVA LERCPCFHQG KEYAPGETVK IGCNTCVCRD RKWNCTDHVC

101  DATCSTIGMA HYLTFDGLKY LFPGECQYVL VQDYCGSNPG TFRILVGNKG

151  CSHPSVKCKK RVTILVEGGE IELFDGEVNV KRPMKDETHF EVVESGRYII

201  LLLGKALSVV WDRHLSISVV LKQTYQEKVC GLCGNFDGIQ NNDLTSSNLQ

251  VEEDPVDFGN SWKVSSQCAD TRKVPLDSSP ATCHNNIMKQ TMVDSSCRIL

301  TSDVFQDCNK LVDPEPYLDV CIYDTCSCES IGDCAAFCDT IAAYAHVCAQ

351  HGKVVTWRTA TLCPQSCEER NLRENGYEAE WRYNSCAPAC QVTCQHPEPL

401  ACPVQCVEGC HAHCPPGKIL DELLQTCVDP EDCPVCEVAG RRFASGKKVT

451  LNPSDPEHCQ ICHCDVVNLT CEACQEPISG TSESATPESG PGSEPATSGS

501  ETPGTSESAT PESGPGSEPA TSGSETPGTS ESATPESGPG TSTEPSEGSA

551  PGSPAGSPTS TEEGTSESAT PESGPGSEPA TSGSETPGTS ESATPESGPG

601  SPAGSPTSIF EGSPAGSPTS TEEGTSTEPS EGSAPGTSES ATPESGPGTS

651  ESATPESGPG TSESATPESG PGSEPATSGS ETPGSEPATS GSETPGSPAG

701  SPTSTEEGTS TEPSEGSAPG TSTEPSEGSA PGSEPATSGS ETPGTSESAT
```

```
 751  PESGPGTSTE PSEGSAPDSG GGGSGGGGSG GGGSGGGGSG GGGSLVPRGS

801  GGASATRRYY LGAVELSWDY MQSDLGELPV DARFPPRVPK SFPFNTSVVY

851  KKTLFVEFTD HLFNIAKPRP PWMGLLGPTI QAEVYDTVVI TLKNMASHPV

901  SLHAVGVSYW KASEGAEYDD QTSQREKEDD KVFPGGSHTY VWQVLKENGP

951  MASDPLCLTY SYLSHVDLVK DLNSGLIGAL LVCREGSLAK EKTQTLHKFI

1001  LLFAVFDEGK SWHSETKNSL MQDRDAASAR AWPKMHTVNG YVNRSLPGLI

1051  GCHRKSVYWH VIGMGTTPEV HSIFLEGHTF LVRNHRQASL EISPITFLTA

1101  QTLLMDLGQF LLFCHISSHQ HDGMEAYVKV DSCPEEPQLR MKNNEEAEDY

1151  DDDLTDSEMD VVRFDDDNSP SFIQIRSVAK KHPKTWVHYI AAEEEDWDYA

1201  PLVLAPDDRS YKSQYLNNGP QRIGRKYKKV RFMAYTDETF KTREAIQHES

1251  GILGPLLYGE VGDTLLIIFK NQASRPYNIY PHGITDVRPL YSRRLPKGVK

1301  HLKDFPILPG EIFKYKWTVT VEDGPTKSDP RCLTRYYSSF VNMERDLASG

1351  LIGPLLICYK ESVDQRGNQI MSDKRNVILF SVFDENRSWY LIENIQRFLP

1401  NPAGVQLEDP EFQASNIMHS INGYVFDSLQ LSVCLHEVAY WYILSIGAQT

1451  DFLSVFFSGY TFKHKMVYED TLTLFPFSGE TVFMSMENPG LWILGCHNSD

1501  FRNRGMTALL KVSSCDKNTG DYYEDSYEDI SAYLLSKNNA IEPRSFSQNP

1551  PVLKRHQREI TRTTLQSDQE EIDYDDTISV EMKKEDFDIY DEDENQSPRS

1601  FQKKTRHYFI AAVERLWDYG MSSSPHVLRN RAQSGSVPQF KKVVFQEFTD

1651  GSFTQPLYRG ELNEHLGLLG PYIRAEVEDN IMVTFRNQAS RPYSFYSSLI

1701  SYEEDQRQGA EPRKNFVKPN ETKTYFWKVQ HHMAPTKDEF DCKAWAYFSD

1751  VDLEKDVHSG LIGPLLVCHT NTLNPAHGRQ VTVQEFALFF TIFDETKSWY

1801  FIENMERNCR APCNIQMEDP TFKENYRFHA INGYIMDTLP GLVMAQDQRI

1851  RWYLLSMGSN ENIHSIHFSG HVFTVRKKEE YKMALYNLYP GVFETVEMLP

1901  SKAGIWRVEC LIGEHLHAGM STLFLVYSNK CQTPLGMASG HIRDFQITAS

1951  GQYGQWAPKL ARLHYSGSIN AWSTKEPFSW IKVDLLAPMI IHGIKTQGAR

2001  QKFSSLYISQ FIIMYSLDGK KWQTYRGNST GTLMVFFGNV DSSGIKHNIF

2051  NPPIIARYIR LHPTHYSIRS TLRMELMGCD LNSCSMPLGM ESKAISDAQI

2101  TASSYFTNMF ATWSPSKARL HLQGRSNAWR PQVNNPKEWL QVDFQKTMKV

2151  TGVTTQGVKS LLTSMYVKEF LISSSQDGHQ WTLFFQNGKV KVFQGNQDSF

2201  TPVVNSLDPP LLTRYLRIHP QSWVHQIALR MEVLGCEAQD LY
``` pSYN FVIII 310 nucleotide sequence (encoding FVIII with
complete B-domain deletion except 2 amino
acid residues and 288 AE-XTEN inserted after aa 742)
(SEQ ID NO: 170)

```
   1  ATGCAAATAG AGCTCTCCAC CTGCTTCTTT CTGTGCCTTT TGCGATTCTG

51  CTTTAGTGCC ACCAGAAGAT ACTACCTGGG TGCAGTGGAA CTGTCATGGG

101  ACTATATGCA AAGTGATCTC GGTGAGCTGC CTGTGGACGC AAGATTTCCT

151  CCTAGAGTGC CAAAATCTTT TCCATTCAAC ACCTCAGTCG TGTACAAAAA

201  GACTCTGTTT GTAGAATTCA CGGATCACCT TTTCAACATC GCTAAGCCAA

251  GGCCACCCTG GATGGGTCTG CTAGGTCCTA CCATCCAGGC TGAGGTTTAT

301  GATACAGTGG TCATTACACT TAAGAACATG GCTTCCCATC CTGTCAGTCT
```

-continued

```
 351 TCATGCTGTT GGTGTATCCT ACTGGAAAGC TTCTGAGGGA GCTGAATATG
 401 ATGATCAGAC CAGTCAAAGG GAGAAAGAAG ATGATAAAGT CTTCCCTGGT
 451 GGAAGCCATA CATATGTCTG GCAGGTCCTG AAAGAGAATG GTCCAATGGC
 501 CTCTGACCCA CTGTGCCTTA CCTACTCATA TCTTTCTCAT GTGGACCTGG
 551 TAAAAGACTT GAATTCAGGC CTCATTGGAG CCCTACTAGT ATGTAGAGAA
 601 GGGAGTCTGG CCAAGGAAAA GACACAGACC TTGCACAAAT TTATACTACT
 651 TTTTGCTGTA TTTGATGAAG GGAAAAGTTG GCACTCAGAA ACAAAGAACT
 701 CCTTGATGCA GGATAGGGAT GCTGCATCTG CTCGGGCCTG GCCTAAAATG
 751 CACACAGTCA ATGGTTATGT AAACAGGTCT CTGCCAGGTC TGATTGGATG
 801 CCACAGGAAA TCAGTCTATT GGCATGTGAT TGGAATGGGC ACCACTCCTG
 851 AAGTGCACTC AATATTCCTC GAAGGTCACA CATTTCTTGT GAGGAACCAT
 901 CGCCAGGCGT CCTTGGAAAT CTCGCCAATA ACTTTCCTTA CTGCTCAAAC
 951 ACTCTTGATG GACCTTGGAC AGTTTCTACT GTTTTGTCAT ATCTCTTCCC
1001 ACCAACATGA TGGCATGGAA GCTTATGTCA AGTAGACAG CTGTCCAGAG
1051 GAACCCCAAC TACGAATGAA AATAATGAA GAAGCGGAAG ACTATGATGA
1101 TGATCTTACT GATTCTGAAA TGGATGTGGT CAGGTTTGAT GATGACAACT
1151 CTCCTTCCTT TATCCAAATT CGCTCAGTTG CCAAGAAGCA TCCTAAAACT
1201 TGGGTACATT ACATTGCTGC TGAAGAGGAG GACTGGGACT ATGCTCCCTT
1251 AGTCCTCGCC CCCGATGACA GAAGTTATAA AAGTCAATAT TTGAACAATG
1301 GCCCTCAGCG GATTGGTAGG AAGTACAAAA AGTCCGATT TATGGCATAC
1351 ACAGATGAAA CCTTTAAGAC TCGTGAAGCT ATTCAGCATG AATCAGGAAT
1401 CTTGGGACCT TTACTTTATG GGGAAGTTGG AGACACACTG TTGATTATAT
1451 TTAAGAATCA AGCAAGCAGA CCATATAACA TCTACCCTCA CGGAATCACT
1501 GATGTCCGTC CTTTGTATTC AAGGAGATTA CCAAAAGGTG TAAAACATTT
1551 GAAGGATTTT CCAATTCTGC CAGGAGAAAT ATTCAAATAT AAATGGACAG
1601 TGACTGTAGA AGATGGGCCA ACTAAATCAG ATCCTCGGTG CCTGACCCGC
1651 TATTACTCTA GTTTCGTTAA TATGGAGAGA GATCTAGCTT CAGGACTCAT
1701 TGGCCCTCTC CTCATCTGCT ACAAAGAATC TGTAGATCAA AGAGGAAACC
1751 AGATAATGTC AGACAAGAGG AATGTCATCC TGTTTTCTGT ATTTGATGAG
1801 AACCGAAGCT GGTACCTCAC AGAGAATATA CAACGCTTTC TCCCCAATCC
1851 AGCTGGAGTG CAGCTTGAGG ATCCAGAGTT CCAAGCCTCC AACATCATGC
1901 ACAGCATCAA TGGCTATGTT TTTGATAGTT TGCAGTTGTC AGTTTGTTTG
1951 CATGAGGTGG CATACTGGTA CATTCTAAGC ATTGGAGCAC AGACTGACTT
2001 CCTTTCTGTC TTCTTCTCTG GATATACCTT CAAACACAAA ATGGTCTATG
2051 AAGACACACT CACCCTATTC CCATTCTCAG GAGAAACTGT CTTCATGTCG
2101 ATGGAAAACC CAGGTCTATG GATTCTGGGG TGCCACAACT CAGACTTTCG
2151 GAACAGAGGC ATGACCGCCT TACTGAAGGT TTCTAGTTGT GACAAGAACA
2201 CTGGTGATTA TTACGAGGAC AGTTATGAAG ATATTTCAGC ATACTTGCTG
2251 AGTAAAAACA ATGCCATTGA ACCAAGAAGC TTCGGTACCT CAGAGTCTGC
2301 TACCCCCGAG TCAGGGCCAG GATCAGAGCC AGCCACCTCC GGGTCTGAGA
```

```
2351 CACCCGGGAC TTCCGAGAGT GCCACCCCTG AGTCCGGACC CGGGTCCGAG

2401 CCCGCCACTT CCGGCTCCGA AACTCCCGGC ACAAGCGAGA GCGCTACCCC

2451 AGAGTCAGGA CCAGGAACAT CTACAGAGCC CTCTGAAGGC TCCGCTCCAG

2501 GGTCCCCAGC CGGCAGTCCC ACTAGCACCG AGGAGGGAAC CTCTGAAAGC

2551 GCCACACCCG AATCAGGGCC AGGGTCTGAG CCTGCTACCA GCGGCAGCGA

2601 GACACCAGGC ACCTCTGAGT CCGCCACACC AGAGTCCGGA CCCGGATCTC

2651 CCGCTGGGAG CCCCACCTCC ACTGAGGAGG GATCTCCTGC TGGCTCTCCA

2701 ACATCTACTG AGGAAGGTAC CTCAACCGAG CCATCCGAGG GATCAGCTCC

2751 CGGCACCTCA GAGTCGGCAA CCCCGGAGTC TGGACCCGGA ACTTCCGAAA

2801 GTGCCACACC AGAGTCCGGT CCCGGGACTT CAGAATCAGC AACACCCGAG

2851 TCCGGCCCTG GGTCTGAACC CGCCACAAGT GGTAGTGAGA CACCAGGATC

2901 AGAACCTGCT ACCTCAGGGT CAGAGACACC CGGATCTCCG GCAGGCTCAC

2951 CAACCTCCAC TGAGGAGGGC ACCAGCACAG AACCAAGCGA GGGCTCCGCA

3001 CCCGGAACAA GCACTGAACC CAGTGAGGGT TCAGCACCCG GCTCTGAGCC

3051 GGCCACAAGT GGCAGTGAGA CACCCGGCAC TTCAGAGAGT GCCACCCCCG

3101 AGAGTGGCCC AGGCACTAGT ACCGAGCCCT CTGAAGGCAG TGCGCCAGCC

3151 TCGAGCGAAA TAACTCGTAC TACTCTTCAG TCAGATCAAG AGGAAATCGA

3201 TTATGATGAT ACCATATCAG TTGAAATGAA GAAGGAAGAT TTTGACATTT

3251 ATGATGAGGA TGAAAATCAG AGCCCCCGCA GCTTTCAAAA GAAAACACGA

3301 CACTATTTTA TTGCTGCAGT GGAGAGGCTC TGGGATTATG GGATGAGTAG

3351 CTCCCCACAT GTTCTAAGAA ACAGGGCTCA GAGTGGCAGT GTCCCTCAGT

3401 TCAAGAAAGT TGTTTTCCAG GAATTTACTG ATGGCTCCTT TACTCAGCCC

3451 TTATACCGTG GAGAACTAAA TGAACATTTG GGACTCCTGG GGCCATATAT

3501 AAGAGCAGAA GTTGAAGATA ATATCATGGT AACTTTCAGA AATCAGGCCT

3551 CTCGTCCCTA TTCCTTCTAT TCTAGCCTTA TTTCTTATGA GGAAGATCAG

3601 AGGCAAGGAG CAGAACCTAG AAAAAACTTT GTCAAGCCTA ATGAAACCAA

3651 AACTTACTTT TGGAAAGTGC AACATCATAT GGCACCCACT AAAGATGAGT

3701 TTGACTGCAA AGCCTGGGCT TATTTCTCTG ATGTTGACCT GGAAAAAGAT

3751 GTGCACTCAG GCCTGATTGG ACCCCTTCTG GTCTGCCACA CTAACACACT

3801 GAACCCTGCT CATGGGAGAC AAGTGACAGT ACAGGAATTT GCTCTGTTTT

3851 TCACCATCTT TGATGAGACC AAAAGCTGGT ACTTCACTGA AAATATGGAA

3901 AGAAACTGCA GGGCTCCCTG CAATATCCAG ATGGAAGATC CCACTTTTAA

3951 AGAGAATTAT CGCTTCCATG CAATCAATGG CTACATAATG GATACACTAC

4001 CTGGCTTAGT AATGGCTCAG GATCAAAGGA TTCGATGGTA TCTGCTCAGC

4051 ATGGGCAGCA ATGAAAACAT CCATTCTATT CATTTCAGTG GACATGTGTT

4101 CACTGTACGA AAAAAGGAGG AGTATAAAAT GGCACTGTAC AATCTCTATC

4151 CAGGTGTTTT TGAGACAGTG GAAATGTTAC CATCCAAAGC TGGAATTTGG

4201 CGGGTGGAAT GCCTTATTGG CGAGCATCTA CATGCTGGGA TGAGCACACT

4251 TTTTCTGGTG TACAGCAATA AGTGTCAGAC TCCCCTGGGA ATGGCTTCTG
```

```
4301 GACACATTAG AGATTTTCAG ATTACAGCTT CAGGACAATA TGGACAGTGG

4351 GCCCCAAAGC TGGCCAGACT TCATTATTCC GGATCAATCA ATGCCTGGAG

4401 CACCAAGGAG CCCTTTTCTT GGATCAAGGT GGATCTGTTG CACCAATGA

4451 TTATTCACGG CATCAAGACC CAGGGTGCCC GTCAGAAGTT CTCCAGCCTC

4501 TACATCTCTC AGTTTATCAT CATGTATAGT CTTGATGGGA AGAAGTGGCA

4551 GACTTATCGA GGAAATTCCA CTGGAACCTT AATGGTCTTC TTTGGCAATG

4601 TGGATTCATC TGGGATAAAA CACAATATTT TTAACCCTCC AATTATTGCT

4651 CGATACATCC GTTTGCACCC AACTCATTAT AGCATTCGCA GCACTCTTCG

4701 CATGGAGTTG ATGGGCTGTG ATTTAAATAG TTGCAGCATG CCATTGGGAA

4751 TGGAGAGTAA AGCAATATCA GATGCACAGA TTACTGCTTC ATCCTACTTT

4801 ACCAATATGT TTGCCACCTG GTCTCCTTCA AAAGCTCGAC TTCACCTCCA

4851 AGGGAGGAGT AATGCCTGGA GACCTCAGGT GAATAATCCA AAAGAGTGGC

4901 TGCAAGTGGA CTTCCAGAAG ACAATGAAAG TCACAGGAGT AACTACTCAG

4951 GGAGTAAAAT CTCTGCTTAC CAGCATGTAT GTGAAGGAGT TCCTCATCTC

5001 CAGCAGTCAA GATGGCCATC AGTGGACTCT CTTTTTTCAG AATGGCAAAG

5051 TAAAGGTTTT TCAGGGAAAT CAAGACTCCT TCACACCTGT GGTGAACTCT

5101 CTAGACCCAC CGTTACTGAC TCGCTACCTT CGAATTCACC CCCAGAGTTG

5151 GGTGCACCAG ATTGCCCTGA GGATGGAGGT TCTGGGCTGC GAGGCACAGG

5201 ACCTCTACGA CAAAACTCAC ACATGCCCAC CGTGCCCAGC TCCAGAACTC

5251 CTGGGCGGAC CGTCAGTCTT CCTCTTCCCC CCAAAACCCA AGGACACCCT

5301 CATGATCTCC CGGACCCCTG AGGTCACATG CGTGGTGGTG GACGTGAGCC

5351 ACGAAGACCC TGAGGTCAAG TTCAACTGGT ACGTGGACGG CGTGGAGGTG

5401 CATAATGCCA AGACAAAGCC GCGGGAGGAG CAGTACAACA GCACGTACCG

5451 TGTGGTCAGC GTCCTCACCG TCCTGCACCA GGACTGGCTG AATGGCAAGG

5501 AGTACAAGTG CAAGGTCTCC AACAAAGCCC TCCCAGCCCC CATCGAGAAA

5551 ACCATCTCCA AAGCCAAAGG GCAGCCCCGA GAACCACAGG TGTACACCCT

5601 GCCCCCATCC CGGGATGAGC TGACCAAGAA CCAGGTCAGC CTGACCTGCC

5651 TGGTCAAAGG CTTCTATCCC AGCGACATCG CCGTGGAGTG GGAGAGCAAT

5701 GGGCAGCCGG AGAACAACTA CAAGACCACG CCTCCCGTGT GGACTCCGA

5751 CGGCTCCTTC TTCCTCTACA GCAAGCTCAC CGTGGACAAG AGCAGGTGGC

5801 AGCAGGGGAA CGTCTTCTCA TGCTCCGTGA TGCATGAGGC TCTGCACAAC

5851 CACTACACGC AGAAGAGCCT CTCCCTGTCT CCGGGTAAAT GA
``` pSYN FVIII 310 protein sequence (FVIII with complete B-domain
deletion except 2 amino acid residues and 288
AE-XTEN inserted after aa 742)

(SEQ ID NO: 171)

```
  1 ATRRYYLGAV ELSWDYMQSD LGELPVDARF PPRVPKSFPF NTSVVYKKTL

51 FVEFTDHLFN IAKPRPPWMG LLGPTIQAEV YDTVVITLKN MASHPVSLHA

101 VGVSYWKASE GAEYDDQTSQ REKEDDKVFP GGSHTYVWQV LKENGPMASD

151 PLCLTYSYLS HVDLVKDLNS GLIGALLVCR EGSLAKEKTQ TLHKFILLFA

201 VFDEGKSWHS ETKNSLMQDR DAASARAWPK MHTVNGYVNR SLPGLIGCHR

251 KSVYWHVIGM GTTPEVHSIF LEGHTFLVRN HRQASLEISP ITFLTAQTLL
```

```
 301 MDLGQFLLFC HISSHQHDGM EAYVKVDSCP EEPQLRMKNN EEAEDYDDDL

351 TDSEMDVVRF DDDNSPSFIQ IRSVAKKHPK TWVHYIAAEE EDWDYAPLVL

401 APDDRSYKSQ YLNNGPQRIG RKYKKVRFMA YTDETFKTRE AIQHESGILG

451 PLLYGEVGDT LLIIFKNQAS RPYNIYPHGI TDVRPLYSRR LPKGVKHLKD

501 FPILPGEIFK YKWTVTVEDG PTKSDPRCLT RYYSSFVNME RDLASGLIGP

551 LLICYKESVD QRGNQIMSDK RNVILFSVFD ENRSWYLTEN IQRFLPNPAG

601 VQLEDPEFQA SNIMHSINGY VFDSLQLSVC LHEVAYWYIL SIGAQTDFLS

651 VFFSGYTFKH KMVYEDTLTL FPFSGETVFM SMENPGLWIL GCHNSDFRNR

701 GMTALLKVSS CDKNTGDYYE DSYEDISAYL LSKNNAIEPR SFGTSESATP

751 ESGPGSEPAT SGSETPGTSE SATPESGPGS EPATSGSETP GTSESATPES

801 GPGTSTEPSE GSAPGSPAGS PTS1EEGTSE SATPESGPGS EPATSGSETP

851 GTSESATPES GPGSPAGSPT S1EEGSPAGS PTSTEEGTST EPSEGSAPGT

901 SESATPESGP GTSESATPES GPGTSESATP ESGPGSEPAT SGSETPGSEP

951 ATSGSETPGS PAGSPTSTEE GTSTEPSEGS APGTSTEPSE GSAPGSEPAT

1001 SGSETPGTSE SATPESGPGT STEPSEGSAP ASSEITRTTL QSDQEEIDYD

1051 DTISVEMKKE DFDIYDEDEN QSPRSFQKKT RHYFIAAVER LWDYGMSSSP

1101 HVLRNRAQSG SVPQFKKVVF QEFTDGSFTQ PLYRGELNEH LGLLGPYIRA

1151 EVEDNIMVTF RNQASRPYSF YSSLISYEED QRQGAEPRKN FVKPNETKTY

1201 FWKVQHHMAP TKDEFDCKAW AYFSDVDLEK DVHSGLIGPL LVCHTNTLNP

1251 AHGRQVTVQE FALFFTIFDE TKSWYFTENM ERNCRAPCNI QMEDPTFKEN

1301 YRFHAINGYI MDTLPGLVMA QDQRIRWYLL SMGSNENIHS IHFSGHVFTV

1351 RKKEEYKMAL YNLYPGVFET VEMLPSKAGI WRVECLIGEH LHAGMSTLFL

1401 VYSNKCQTPL GMASGHIRDF QITASGQYGQ WAPKLARLHY SGSINAWSTK

1451 EPFSWIKVDL LAPMIIHGIK TQGARQKFSS LYISQFIIMY SLDGKKWQTY

1501 RGNSTGTLMV FFGNVDSSGI KHNIFNPPII ARYIRLHPTH YSIRSTLRME

1551 LMGCDLNSCS MPLGMESKAI SDAQITASSY FTNMFATWSP SKARLHLQGR

1601 SNAWRPQVNN PKEWLQVDFQ KTMKVTGVTT QGVKSLLTSM YVKEFLISSS

1651 QDGHQWTLFF QNGKVKVFQG NQDSFTPVVN SLDPPLLTRY LRIHPQSWVH

1701 QIALRMEVLG CEAQDLYDKT HTCPPCPAPE LLGGPSVFLF PPKPKDTLMI

1751 SRTPEVTCVV VDVSHEDPEV KFNWYVDGVE VHNAKTKPRE EQYNSTYRVV

1801 SVLTVLHQDW LNGKEYKCKV SNKALPAPIE KTISKAKGQP REPQVYTLPP

1851 SRDELTKNQV SLTCLVKGFY PSDIAVEWES NGQPENNYKT TPPVLDSDGS

1901 FFLYSKLTVD KSRWQQGNVF SCSVMHEALH NHYTQKSLSL SPGK* pSYN FVIII 312 nucleotide sequence (encoding FVIII with
complete B-domain deletion except 5 amino acid
residues and 288 AE-XTEN inserted after aa 745-B5 version)
                                                   (SEQ ID NO: 172)
   1 ATGCAAATAG AGCTCTCCAC CTGCTTCTTT CTGTGCCTTT TGCGATTCTG

51 CTTTAGTGCC ACCAGAAGAT ACTACCTGGG TGCAGTGGAA CTGTCATGGG

101 ACTATATGCA AAGTGATCTC GGTGAGCTGC CTGTGGACGC AAGATTTCCT

151 CCTAGAGTGC CAAAATCTTT TCCATTCAAC ACCTCAGTCG TGTACAAAAA
```

-continued

```
 201 GACTCTGTTT GTAGAATTCA CGGATCACCT TTTCAACATC GCTAAGCCAA
 251 GGCCACCCTG GATGGGTCTG CTAGGTCCTA CCATCCAGGC TGAGGTTTAT
 301 GATACAGTGG TCATTACACT TAAGAACATG GCTTCCCATC CTGTCAGTCT
 351 TCATGCTGTT GGTGTATCCT ACTGGAAAGC TTCTGAGGGA GCTGAATATG
 401 ATGATCAGAC CAGTCAAAGG GAGAAAGAAG ATGATAAAGT CTTCCCTGGT
 451 GGAAGCCATA CATATGTCTG GCAGGTCCTG AAAGAGAATG GTCCAATGGC
 501 CTCTGACCCA CTGTGCCTTA CCTACTCATA TCTTTCTCAT GTGGACCTGG
 551 TAAAAGACTT GAATTCAGGC CTCATTGGAG CCCTACTAGT ATGTAGAGAA
 601 GGGAGTCTGG CCAAGGAAAA GACACAGACC TTGCACAAAT TTATACTACT
 651 TTTTGCTGTA TTTGATGAAG GGAAAAGTTG GCACTCAGAA ACAAAGAACT
 701 CCTTGATGCA GGATAGGGAT GCTGCATCTG CTCGGGCCTG GCCTAAAATG
 751 CACACAGTCA ATGGTTATGT AAACAGGTCT CTGCCAGGTC TGATTGGATG
 801 CCACAGGAAA TCAGTCTATT GGCATGTGAT TGGAATGGGC ACCACTCCTG
 851 AAGTGCACTC AATATTCCTC GAAGGTCACA CATTTCTTGT GAGGAACCAT
 901 CGCCAGGCGT CCTTGGAAAT CTCGCCAATA ACTTTCCTTA CTGCTCAAAC
 951 ACTCTTGATG GACCTTGGAC AGTTTCTACT GTTTTGTCAT ATCTCTTCCC
1001 ACCAACATGA TGGCATGGAA GCTTATGTCA AAGTAGACAG CTGTCCAGAG
1051 GAACCCCAAC TACGAATGAA AAATAATGAA GAAGCGGAAG ACTATGATGA
1101 TGATCTTACT GATTCTGAAA TGGATGTGGT CAGGTTTGAT GATGACAACT
1151 CTCCTTCCTT TATCCAAATT CGCTCAGTTG CCAAGAAGCA TCCTAAAACT
1201 TGGGTACATT ACATTGCTGC TGAAGAGGAG GACTGGGACT ATGCTCCCTT
1251 AGTCCTCGCC CCCGATGACA GAAGTTATAA AGTCAATAT TTGAACAATG
1301 GCCCTCAGCG GATTGGTAGG AAGTACAAAA AGTCCGATT TATGGCATAC
1351 ACAGATGAAA CCTTTAAGAC TCGTGAAGCT ATTCAGCATG AATCAGGAAT
1401 CTTGGGACCT TTACTTTATG GGGAAGTTGG AGACACACTG TTGATTATAT
1451 TTAAGAATCA AGCAAGCAGA CCATATAACA TCTACCCTCA CGGAATCACT
1501 GATGTCCGTC CTTTGTATTC AAGGAGATTA CCAAAAGGTG TAAAACATTT
1551 GAAGGATTTT CCAATTCTGC CAGGAGAAAT ATTCAAATAT AAATGGACAG
1601 TGACTGTAGA AGATGGGCCA ACTAAATCAG ATCCTCGGTG CCTGACCCGC
1651 TATTACTCTA GTTTCGTTAA TATGGAGAGA GATCTAGCTT CAGGACTCAT
1701 TGGCCCTCTC CTCATCTGCT ACAAAGAATC TGTAGATCAA GAGGAAACC
1751 AGATAATGTC AGACAAGAGG AATGTCATCC TGTTTTCTGT ATTTGATGAG
1801 AACCGAAGCT GGTACCTCAC AGAGAATATA CAACGCTTTC TCCCCAATCC
1851 AGCTGGAGTG CAGCTTGAGG ATCCAGAGTT CCAAGCCTCC AACATCATGC
1901 ACAGCATCAA TGGCTATGTT TTTGATAGTT TGCAGTTGTC AGTTTGTTTG
1951 CATGAGGTGG CATACTGGTA CATTCTAAGC ATTGGAGCAC AGACTGACTT
2001 CCTTTCTGTC TTCTTCTCTG GATATACCTT CAAACACAAA ATGGTCTATG
2051 AAGACACACT CACCCTATTC CCATTCTCAG GAGAAACTGT CTTCATGTCG
2101 ATGGAAAACC CAGGTCTATG GATTCTGGGG TGCCACAACT CAGACTTTCG
2151 GAACAGAGGC ATGACCGCCT TACTGAAGGT TTCTAGTTGT GACAAGAACA
```

-continued

```
2201  CTGGTGATTA TTACGAGGAC AGTTATGAAG ATATTTCAGC ATACTTGCTG

2251  AGTAAAAACA ATGCCATTGA ACCAAGAAGC TTCTCTCAAA ACGGTACCTC

2301  AGAGTCTGCT ACCCCCGAGT CAGGGCCAGG ATCAGAGCCA GCCACCTCCG

2351  GGTCTGAGAC ACCCGGGACT TCCGAGAGTG CCACCCCTGA GTCCGGACCC

2401  GGGTCCGAGC CCGCCACTTC CGGCTCCGAA ACTCCCGGCA CAAGCGAGAG

2451  CGCTACCCCA GAGTCAGGAC CAGGAACATC TACAGAGCCC TCTGAAGGCT

2501  CCGCTCCAGG GTCCCCAGCC GGCAGTCCCA CTAGCACCGA GGAGGGAACC

2551  TCTGAAAGCG CCACACCCGA ATCAGGGCCA GGGTCTGAGC CTGCTACCAG

2601  CGGCAGCGAG ACACCAGGCA CCTCTGAGTC CGCCACACCA GAGTCCGGAC

2651  CCGGATCTCC CGCTGGGAGC CCCACCTCCA CTGAGGAGGG ATCTCCTGCT

2701  GGCTCTCCAA CATCTACTGA GGAAGGTACC TCAACCGAGC CATCCGAGGG

2751  ATCAGCTCCC GGCACCTCAG AGTCGGCAAC CCCGGAGTCT GGACCCGGAA

2801  CTTCCGAAAG TGCCACACCA GAGTCCGGTC CCGGGACTTC AGAATCAGCA

2851  ACACCCGAGT CCGGCCCTGG GTCTGAACCC GCCACAAGTG GTAGTGAGAC

2901  ACCAGGATCA GAACCTGCTA CCTCAGGGTC AGAGACACCC GGATCTCCGG

2951  CAGGCTCACC AACCTCCACT GAGGAGGGCA CCAGCACAGA ACCAAGCGAG

3001  GGCTCCGCAC CCGGAACAAG CACTGAACCC AGTGAGGGTT CAGCACCCGG

3051  CTCTGAGCCG GCCACAAGTG GCAGTGAGAC ACCCGGCACT TCAGAGAGTG

3101  CCACCCCCGA GAGTGGCCCA GGCACTAGTA CCGAGCCCTC TGAAGGCAGT

3151  GCGCCAGCCT CGAGCGAAAT AACTCGTACT ACTCTTCAGT CAGATCAAGA

3201  GGAAATCGAT TATGATGATA CCATATCAGT TGAAATGAAG AAGGAAGATT

3251  TTGACATTTA TGATGAGGAT GAAATCAGA GCCCCCGCAG CTTTCAAAAG

3301  AAAACACGAC ACTATTTTAT TGCTGCAGTG GAGAGGCTCT GGGATTATGG

3351  GATGAGTAGC TCCCCACATG TTCTAAGAAA CAGGGCTCAG AGTGGCAGTG

3401  TCCCTCAGTT CAAGAAAGTT GTTTTCCAGG AATTTACTGA TGGCTCCTTT

3451  ACTCAGCCCT TATACCGTGG AGAACTAAAT GAACATTTGG GACTCCTGGG

3501  GCCATATATA AGAGCAGAAG TTGAAGATAA TATCATGGTA ACTTTCAGAA

3551  ATCAGGCCTC TCGTCCCTAT TCCTTCTATT CTAGCCTTAT TTCTTATGAG

3601  GAAGATCAGA GGCAAGGAGC AGAACCTAGA AAAAACTTTG TCAAGCCTAA

3651  TGAAACCAAA ACTTACTTTT GGAAAGTGCA ACATCATATG GCACCCACTA

3701  AAGATGAGTT TGACTGCAAA GCCTGGGCTT ATTTCTCTGA TGTTGACCTG

3751  GAAAAGATG TGCACTCAGG CCTGATTGGA CCCCTTCTGG TCTGCCACAC

3801  TAACACACTG AACCCTGCTC ATGGGAGACA AGTGACAGTA CAGGAATTTG

3851  CTCTGTTTTT CACCATCTTT GATGAGACCA AAAGCTGGTA CTTCACTGAA

3901  AATATGGAAA GAAACTGCAG GGCTCCCTGC AATATCCAGA TGGAAGATCC

3951  CACTTTTAAA GAGAATTATC GCTTCCATGC AATCAATGGC TACATAATGG

4001  ATACACTACC TGGCTTAGTA ATGGCTCAGG ATCAAAGGAT TCGATGGTAT

4051  CTGCTCAGCA TGGGCAGCAA TGAAAACATC CATTCTATTC ATTTCAGTGG

4101  ACATGTGTTC ACTGTACGAA AAAAGGAGGA GTATAAAATG GCACTGTACA
```

-continued

```
4151 ATCTCTATCC AGGTGTTTTT GAGACAGTGG AAATGTTACC ATCCAAAGCT
4201 GGAATTTGGC GGGTGGAATG CCTTATTGGC GAGCATCTAC ATGCTGGGAT
4251 GAGCACACTT TTTCTGGTGT ACAGCAATAA GTGTCAGACT CCCCTGGGAA
4301 TGGCTTCTGG ACACATTAGA GATTTTCAGA TTACAGCTTC AGGACAATAT
4351 GGACAGTGGG CCCCAAAGCT GGCCAGACTT CATTATTCCG GATCAATCAA
4401 TGCCTGGAGC ACCAAGGAGC CCTTTTCTTG GATCAAGGTG GATCTGTTGG
4451 CACCAATGAT TATTCACGGC ATCAAGACCC AGGGTGCCCG TCAGAAGTTC
4501 TCCAGCCTCT ACATCTCTCA GTTTATCATC ATGTATAGTC TTGATGGGAA
4551 GAAGTGGCAG ACTTATCGAG GAAATTCCAC TGGAACCTTA ATGGTCTTCT
4601 TTGGCAATGT GGATTCATCT GGGATAAAAC ACAATATTTT TAACCCTCCA
4651 ATTATTGCTC GATACATCCG TTTGCACCCA ACTCATTATA GCATTCGCAG
4701 CACTCTTCGC ATGGAGTTGA TGGGCTGTGA TTTAAATAGT TGCAGCATGC
4751 CATTGGGAAT GGAGAGTAAA GCAATATCAG ATGCACAGAT TACTGCTTCA
4801 TCCTACTTTA CCAATATGTT TGCCACCTGG TCTCCTTCAA AAGCTCGACT
4851 TCACCTCCAA GGGAGGAGTA ATGCCTGGAG ACCTCAGGTG AATAATCCAA
4901 AAGAGTGGCT GCAAGTGGAC TTCCAGAAGA CAATGAAAGT CACAGGAGTA
4951 ACTACTCAGG GAGTAAAATC TCTGCTTACC AGCATGTATG TGAAGGAGTT
5001 CCTCATCTCC AGCAGTCAAG ATGGCCATCA GTGGACTCTC TTTTTTCAGA
5051 ATGGCAAAGT AAAGGTTTTT CAGGGAAATC AAGACTCCTT CACACCTGTG
5101 GTGAACTCTC TAGACCCACC GTTACTGACT CGCTACCTTC GAATTCACCC
5151 CCAGAGTTGG GTGCACCAGA TTGCCCTGAG GATGGAGGTT CTGGGCTGCG
5201 AGGCACAGGA CCTCTACGAC AAAACTCACA CATGCCCACC GTGCCCAGCT
5251 CCAGAACTCC TGGGCGGACC GTCAGTCTTC CTCTTCCCCC CAAAACCCAA
5301 GGACACCCTC ATGATCTCCC GGACCCCTGA GGTCACATGC GTGGTGGTGG
5351 ACGTGAGCCA CGAAGACCCT GAGGTCAAGT TCAACTGGTA CGTGGACGGC
5401 GTGGAGGTGC ATAATGCCAA GACAAAGCCG CGGGAGGAGC AGTACAACAG
5451 CACGTACCGT GTGGTCAGCG TCCTCACCGT CCTGCACCAG GACTGGCTGA
5501 ATGGCAAGGA GTACAAGTGC AAGGTCTCCA ACAAAGCCCT CCCAGCCCCC
5551 ATCGAGAAAA CCATCTCCAA AGCCAAAGGG CAGCCCCGAG AACCACAGGT
5601 GTACACCCTG CCCCCATCCC GGGATGAGCT GACCAAGAAC CAGGTCAGCC
5651 TGACCTGCCT GGTCAAAGGC TTCTATCCCA GCGACATCGC CGTGGAGTGG
5701 GAGAGCAATG GGCAGCCGGA GAACAACTAC AAGACCACGC CTCCCGTGTT
5751 GGACTCCGAC GGCTCCTTCT TCCTCTACAG CAAGCTCACC GTGGACAAGA
5801 GCAGGTGGCA GCAGGGGAAC GTCTTCTCAT GCTCCGTGAT GCATGAGGCT
5851 CTGCACAACC ACTACACGCA AAGAGCCTC TCCCTGTCTC CGGGTAAATG
``` pSYN FVIII 312 protein sequence (FVIII with complete
B-domain deletion except 5 amino acid
residues and 288 AE-XTEN inserted after aa 745-B5 version)

(SEQ ID NO: 173)

```
  1 ATRRYYLGAV ELSWDYMQSD LGELPVDARF PPRVPKSFPF NTSVVYKKTL
 51 FVEFTDHLFN IAKPRPPWMG LLGPTIQAEV YDTVVITLKN MASHPVSLHA
101 VGVSYWKASE GAEYDDQTSQ REKEDDKVFP GGSHTYVWQV LKENGPMASD
```

```
 151 PLCLTYSYLS HVDLVKDLNS GLIGALLVCR EGSLAKEKTQ TLHKFILLFA

201 VFDEGKSWHS ETKNSLMQDR DAASARAWPK MHTVNGYVNR SLPGLIGCHR

251 KSVYWHVIGM GTTPEVHSIF LEGHTFLVRN HRQASLEISP ITFLTAQTLL

301 MDLGQFLLFC HISSHQHDGM EAYVKVDSCP EEPQLRMKNN EEAEDYDDDL

351 TDSEMDVVRF DDDNSPSFIQ IRSVAKKHPK TWVHYIAAEE EDWDYAPLVL

401 APDDRSYKSQ YLNNGPQRIG RKYKKVRFMA YTDETFKTRE AIQHESGILG

451 PLLYGEVGDT LLIIFKNQAS RPYNIYPHGI TDVRPLYSRR LPKGVKHLKD

501 FPILPGEIFK YKWTVTVEDG PTKSDPRCLT RYYSSFVNME RDLASGLIGP

551 LLICYKESVD QRGNQIMSDK RNVILFSVFD ENRSWYLTEN IQRFLPNPAG

601 VQLEDPEFQA SNIMHSINGY VFDSLQLSVC LHEVAYWYIL SIGAQTDFLS

651 VFFSGYTFKH KMVYEDTLTL FPFSGETVFM SMENPGLWIL GCHNSDFRNR

701 GMTALLKVSS CDKNTGDYYE DSYEDISAYL LSKNNAIEPR SFSQNGTSES

751 ATPESGPGSE PATSGSETPG TSESATPESG PGSEPATSGS ETPGTSESAT

801 PESGPGTSTE PSEGSAPGSP AGSPTSTEEG TSESATPESG PGSEPATSGS

851 ETPGTSESAT PESGPGSPAG SPTSTEEGSP AGSPTSTEEG TSTEPSEGSA

901 PGTSESATPE SGPGTSESAT PESGPGTSES ATPESGPGSE PATSGSETPG

951 SEPATSGSET PGSPAGSPTS TEEGTSTEPS EGSAPGTSTE PSEGSAPGSE

1001 PATSGSETPG TSESATPESG PGTSIEPSEG SAPASSEITR TTLQSDQEEI

1051 DYDDTISVEM KKEDFDIYDE DENQSPRSFQ KKTRHYFIAA VERLWDYGMS

1101 SSPHVLRNRA QSGSVPQFKK VVFQEFTDGS FTQPLYRGEL NEHLGLLGPY

1151 IRAEVEDNIM VTFRNQASRP YSFYSSLISY EEDQRQGAEP RKNFVKPNET

1201 KTYFWKVQHH MAPTKDEFDC KAWAYFSDVD LEKDVHSGLI GPLLVCHTNT

1251 LNPAHGRQVT VQEFALFFTI FDETKSWYFT ENMERNCRAP CNIQMEDPTF

1301 KENYRFHAIN GYIMDTLPGL VMAQDQRIRW YLLSMGSNEN IHSIHFSGHV

1351 FTVRKKEEYK MALYNLYPGV FETVEMLPSK AGIWRVECLI GEHLHAGMST

1401 LFLVYSNKCQ TPLGMASGHI RDFQITASGQ YGQWAPKLAR LHYSGSINAW

1451 STKEPFSWIK VDLLAPMIIH GIKTQGARQK FSSLYISQFI IMYSLDGKKW

1501 QTYRGNSTGT LMVFFGNVDS SGIKHNIFNP PIIARYIRLH PTHYSIRSTL

1551 RMELMGCDLN SCSMPLGMES KAISDAQITA SSYFTNMFAT WSPSKARLHL

1601 QGRSNAWRPQ VNNPKEWLQV DFQKTMKVTG VTTQGVKSLL TSMYVKEFLI

1651 SSSQDGHQWT LFFQNGKVKV FQGNQDSFTP VVNSLDPPLL TRYLRIHPQS

1701 WVHQIALRME VLGCEAQDLY DKTHTCPPCP APELLGGPSV FLFPPKPKDT

1751 LMISRTPEVT CVVVDVSHED PEVKFNWYVD GVEVHNAKTK PREEQYNSTY

1801 RVVSVLTVLH QDWLNGKEYK CKVSNKALPA PIEKTISKAK GQPREPQVYT

1851 LPPSRDELTK NQVSLTCLVK GFYPSDIAVE WESNGQPENN YKTTPPVLDS

1901 DGSFFLYSKL TVDKSRWQQG NVFSCSVMHE ALHNHYTQKS LSLSPGK* pSYN VVVF059 nucleotide sequence (encoding VWF D'D3-Fc with
acidic region 2 (a2) thrombin site in the linker)
                                                   (SEQ ID NO: 196)
   1 ATGATTCCTG CCAGATTTGC CGGGGTGCTG CTTGCTCTGG CCCTCATTTT

51 GCCAGGGACC CTTTGTGCAG AAGGAACTCG CGGCAGGTCA TCCACGGCCC
```

```
 101 GATGCAGCCT TTTCGGAAGT GACTTCGTCA ACACCTTTGA TGGGAGCATG
 151 TACAGCTTTG CGGGATACTG CAGTTACCTC CTGGCAGGGG GCTGCCAGAA
 201 ACGCTCCTTC TCGATTATTG GGGACTTCCA GAATGGCAAG AGAGTGAGCC
 251 TCTCCGTGTA TCTTGGGGAA TTTTTTGACA TCCATTTGTT TGTCAATGGT
 301 ACCGTGACAC AGGGGGACCA AAGAGTCTCC ATGCCCTATG CCTCCAAAGG
 351 GCTGTATCTA GAAACTGAGG CTGGGTACTA CAAGCTGTCC GGTGAGGCCT
 401 ATGGCTTTGT GGCCAGGATC GATGGCAGCG GCAACTTTCA AGTCCTGCTG
 451 TCAGACAGAT ACTTCAACAA GACCTGCGGG CTGTGTGGCA ACTTTAACAT
 501 CTTTGCTGAA GATGACTTTA TGACCCAAGA AGGGACCTTG ACCTCGGACC
 551 CTTATGACTT TGCCAACTCA TGGGCTCTGA GCAGTGGAGA ACAGTGGTGT
 601 GAACGGGCAT CTCCTCCCAG CAGCTCATGC AACATCTCCT CTGGGGAAAT
 651 GCAGAAGGGC CTGTGGGAGC AGTGCCAGCT TCTGAAGAGC ACCTCGGTGT
 701 TTGCCCGCTG CCACCCTCTG GTGGACCCCG AGCCTTTTGT GGCCCTGTGT
 751 GAGAAGACTT TGTGTGAGTG TGCTGGGGGG CTGGAGTGCG CCTGCCCTGC
 801 CCTCCTGGAG TACGCCCGGA CCTGTGCCCA GGAGGGAATG GTGCTGTACG
 851 GCTGGACCGA CCACAGCGCG TGCAGCCCAG TGTGCCCTGC TGGTATGGAG
 901 TATAGGCAGT GTGTGTCCCC TTGCGCCAGG ACCTGCCAGA GCCTGCACAT
 951 CAATGAAATG TGTCAGGAGC GATGCGTGGA TGGCTGCAGC TGCCCTGAGG
1001 GACAGCTCCT GGATGAAGGC CTCTGCGTGG AGAGCACCGA GTGTCCCTGC
1051 GTGCATTCCG GAAAGCGCTA CCCTCCCGGC ACCTCCCTCT CTCGAGACTG
1101 CAACACCTGC ATTTGCCGAA ACAGCCAGTG GATCTGCAGC AATGAAGAAT
1151 GTCCAGGGGA GTGCCTTGTC ACTGGTCAAT CCCACTTCAA GAGCTTTGAC
1201 AACAGATACT TCACCTTCAG TGGGATCTGC CAGTACCTGC TGGCCCGGGA
1251 TTGCCAGGAC CACTCCTTCT CCATTGTCAT TGAGACTGTC CAGTGTGCTG
1301 ATGACCGCGA CGCTGTGTGC ACCCGCTCCG TCACCGTCCG GCTGCCTGGC
1351 CTGCACAACA GCCTTGTGAA ACTGAAGCAT GGGGCAGGAG TTGCCATGGA
1401 TGGCCAGGAC ATCCAGCTCC CCCTCCTGAA AGGTGACCTC CGCATCCAGC
1451 ATACAGTGAC GGCCTCCGTG CGCCTCAGCT ACGGGGAGGA CCTGCAGATG
1501 GACTGGGATG GCCGCGGGAG GCTGCTGGTG AAGCTGTCCC CCGTCTATGC
1551 CGGGAAGACC TGCGGCCTGT GTGGGAATTA CAATGGCAAC CAGGGCGACG
1601 ACTTCCTTAC CCCCTCTGGG CTGGCGGAGC CCCGGGTGGA GGACTTCGGG
1651 AACGCCTGGA AGCTGCACGG GGACTGCCAG GACCTGCAGA AGCAGCACAG
1701 CGATCCCTGC GCCCTCAACC CGCGCATGAC CAGGTTCTCC GAGGAGGCGT
1751 GCGCGGTCCT GACGTCCCCC ACATTCGAGG CCTGCCATCG TGCCGTCAGC
1801 CCGCTGCCCT ACCTGCGGAA CTGCCGCTAC GACGTGTGCT CCTGCTCGGA
1851 CGGCCGCGAG TGCCTGTGCG GCGCCCTGGC CAGCTATGCC GCGGCCTGCG
1901 CGGGGAGAGG CGTGCGCGTC GCGTGGCGCG AGCCAGGCCG CTGTGAGCTG
1951 AACTGCCCGA AAGGCCAGGT GTACCTGCAG TGCGGGACCC CCTGCAACCT
2001 GACCTGCCGC TCTCTCTCTT ACCCGGATGA GGAATGCAAT GAGGCCTGCC
```

```
2051  TGGAGGGCTG CTTCTGCCCC CCAGGGCTCT ACATGGATGA GAGGGGGGAC
2101  TGCGTGCCCA AGGCCCAGTG CCCCTGTTAC TATGACGGTG AGATCTTCCA
2151  GCCAGAAGAC ATCTTCTCAG ACCATCACAC CATGTGCTAC TGTGAGGATG
2201  GCTTCATGCA CTGTACCATG AGTGGAGTCC CCGGAAGCTT GCTGCCTGAC
2251  GCTGTCCTCA GCAGTCCCCT GTCTCATCGC AGCAAAAGGA GCCTATCCTG
2301  TCGGCCCCCC ATGGTCAAGC TGGTGTGTCC CGCTGACAAC CTGCGGGCTG
2351  AAGGGCTCGA GTGTACCAAA ACGTGCCAGA ACTATGACCT GGAGTGCATG
2401  AGCATGGGCT GTGTCTCTGG CTGCCTCTGC CCCCCGGGCA TGGTCCGGCA
2451  TGAGAACAGA TGTGTGGCCC TGGAAAGGTG TCCCTGCTTC CATCAGGGCA
2501  AGGAGTATGC CCCTGGAGAA ACAGTGAAGA TTGGCTGCAA CACTTGTGTC
2551  TGTCGGGACC GGAAGTGGAA CTGCACAGAC CATGTGTGTG ATGCCACGTG
2601  CTCCACGATC GGCATGGCCC ACTACCTCAC CTTCGACGGG CTCAAATACC
2651  TGTTCCCCGG GGAGTGCCAG TACGTTCTGG TGCAGGATTA CTGCGGCAGT
2701  AACCCTGGGA CCTTTCGGAT CCTAGTGGGG AATAAGGGAT GCAGCCACCC
2751  CTCAGTGAAA TGCAAGAAAC GGGTCACCAT CCTGGTGGAG GGAGGAGAGA
2801  TTGAGCTGTT TGACGGGGAG GTGAATGTGA AGAGGCCCAT GAAGGATGAG
2851  ACTCACTTTG AGGTGGTGGA GTCTGGCCGG TACATCATTC TGCTGCTGGG
2901  CAAAGCCCTC TCCGTGGTCT GGGACCGCCA CCTGAGCATC TCCGTGGTCC
2951  TGAAGCAGAC ATACCAGGAG AAAGTGTGTG GCCTGTGTGG GAATTTTGAT
3001  GGCATCCAGA ACAATGACCT CACCAGCAGC AACCTCCAAG TGGAGGAAGA
3051  CCCTGTGGAC TTTGGGAACT CCTGGAAAGT GAGCTCGCAG TGTGCTGACA
3101  CCAGAAAAGT GCCTCTGGAC TCATCCCCTG CCACCTGCCA TAACAACATC
3151  ATGAAGCAGA CGATGGTGGA TTCCTCCTGT AGAATCCTTA CCAGTGACGT
3201  CTTCCAGGAC TGCAACAAGC TGGTGGACCC CGAGCCATAT CTGGATGTCT
3251  GCATTTACGA CACCTGCTCC TGTGAGTCCA TTGGGGACTG CGCCGCATTC
3301  TGCGACACCA TTGCTGCCTA TGCCCACGTG TGTGCCCAGC ATGGCAAGGT
3351  GGTGACCTGG AGGACGGCCA CATTGTGCCC CCAGAGCTGC GAGGAGAGGA
3401  ATCTCCGGGA GAACGGGTAT GAGGCTGAGT GGCGCTATAA CAGCTGTGCA
3451  CCTGCCTGTC AAGTCACGTG TCAGCACCCT GAGCCACTGG CCTGCCCTGT
3501  GCAGTGTGTG GAGGGCTGCC ATGCCCACTG CCCTCCAGGG AAAATCCTGG
3551  ATGAGCTTTT GCAGACCTGC GTTGACCCTG AAGACTGTCC AGTGTGTGAG
3601  GTGGCTGGCC GGCGTTTTGC CTCAGGAAAG AAAGTCACCT TGAATCCCAG
3651  TGACCCTGAG CACTGCCAGA TTTGCCACTG TGATGTTGTC AACCTCACCT
3701  GTGAAGCCTG CCAGGAGCCG ATATCGGGCG CGCCAACATC AGAGAGCGCC
3751  ACCCCTGAAA GTGGTCCCGG GAGCGAGCCA GCCACATCTG GGTCGGAAAC
3801  GCCAGGCACA AGTGAGTCTG CAACTCCCGA GTCCGGACCT GGCTCCGAGC
3851  CTGCCACTAG CGGCTCCGAG ACTCCGGGAA CTTCCGAGAG CGCTACACCA
3901  GAAAGCGGAC CCGGAACCAG TACCGAACCT AGCGAGGGCT CTGCTCCGGG
3951  CAGCCCAGCC GGCTCTCCTA CATCCACGGA GGAGGGCACT TCCGAATCCG
4001  CCACCCCGGA GTCAGGGCCA GGATCTGAAC CCGCTACCTC AGGCAGTGAG
```

```
4051 ACGCCAGGAA CGAGCGAGTC CGCTACACCG GAGAGTGGGC CAGGGAGCCC
4101 TGCTGGATCT CCTACGTCCA CTGAGGAAGG GTCACCAGCG GGCTCGCCCA
4151 CCAGCACTGA AGAAGGTGCC TCGATATCTG ACAAGAACAC TGGTGATTAT
4201 TACGAGGACA GTTATGAAGA TATTTCAGCA TACTTGCTGA GTAAAAACAA
4251 TGCCATTGAA CCAAGAAGCT TCTCTGACAA AACTCACACA TGCCCACCGT
4301 GCCCAGCTCC AGAACTCCTG GGCGGACCGT CAGTCTTCCT CTTCCCCCCA
4351 AAACCCAAGG ACACCCTCAT GATCTCCCGG ACCCCTGAGG TCACATGCGT
4401 GGTGGTGGAC GTGAGCCACG AAGACCCTGA GGTCAAGTTC AACTGGTACG
4451 TGGACGGCGT GGAGGTGCAT AATGCCAAGA CAAAGCCGCG GGAGGAGCAG
4501 TACAACAGCA CGTACCGTGT GGTCAGCGTC CTCACCGTCC TGCACCAGGA
4551 CTGGCTGAAT GGCAAGGAGT ACAAGTGCAA GGTCTCCAAC AAAGCCCTCC
4601 CAGCCCCCAT CGAGAAAACC ATCTCCAAAG CCAAAGGGCA GCCCCGAGAA
4651 CCACAGGTGT ACACCCTGCC CCCATCCCGG GATGAGCTGA CCAAGAACCA
4701 GGTCAGCCTG ACCTGCCTGG TCAAAGGCTT CTATCCCAGC GACATCGCCG
4751 TGGAGTGGGA GAGCAATGGG CAGCCGGAGA ACAACTACAA GACCACGCCT
4801 CCCGTGTTGG ACTCCGACGG CTCCTTCTTC CTCTACAGCA AGCTCACCGT
4851 GGACAAGAGC AGGTGGCAGC AGGGGAACGT CTTCTCATGC TCCGTGATGC
4901 ATGAGGCTCT GCACAACCAC TACACGCAGA AGAGCCTCTC CCTGTCTCCG
4951 GGTAAATGA
``` pSYN VWF059 protein sequence (VWF D'D3-Fc with a2 region of
FVIII thrombin site in the linker)-bold underlined area
shows a2 region (SEQ ID NO: 197)

```
  1 MIPARFAGVL LALALILPGT LCAEGTRGRS STARCSLFGS DFVNTFDGSM
 51 YSFAGYCSYL LAGGCQKRSF SIIGDFQNGK RVSLSVYLGE FFDIHLFVNG
101 TVTQGDQRVS MPYASKGLYL EIEAGYYKLS GEAYGFVARI DGSGNFQVLL
151 SDRYFNKTCG LCGNFNIFAE DDFMTQEGTL TSDPYDFANS WALSSGEQWC
201 ERASPPSSSC NISSGEMQKG LWEQCQLLKS TSVFARCHPL VDPEPFVALC
251 EKTLCECAGG LECACPALLE YARTCAQEGM VLYGWTDHSA CSPVCPAGME
301 YRQCVSPCAR TCQSLHINEM CQERCVDGCS CPEGQLLDEG LCVESTECPC
351 VHSGKRYPPG TSLSRDCNTC ICRNSQWICS NEECPGECLV TGQSHFKSFD
401 NRYFTFSGIC QYLLARDCQD HSFSIVIETV QCADDRDAVC TRSVTVRLPG
451 LHNSLVKLKH GAGVAMDGQD IQLPLLKGDL RIQHTVTASV RLSYGEDLQM
501 DWDGRGRLLV KLSPVYAGKT CGLCGNYNGN QGDDFLTPSG LAEPRVEDFG
551 NAWKLHGDCQ DLQKQHSDPC ALNPRMTRFS EEACAVLTSP TFEACHRAVS
601 PLPYLRNCRY DVCSCSDGRE CLCGALASYA AACAGRGVRV AWREPGRCEL
651 NCPKGQVYLQ CGTPCNLTCR SLSYPDEECN EACLEGCFCP PGLYMDERGD
701 CVPKAQCPCY YDGEIFQPED IFSDHHTMCY CEDGFMHCTM SGVPGSLLPD
751 AVLSSPLSHR SKRSLSCRPP MVKLVCPADN LRAEGLECTK TCQNYDLECM
801 SMGCVSGCLC PPGMVRHENR CVALERCPCF HQGKEYAPGE TVKIGCNTCV
851 CRDRKWNCTD HVCDATCSTI GMAHYLTFDG LKYLFPGECQ YVLVQDYCGS
```

```
 901 NPGTFRILVG NKGCSHPSVK CKKRVTILVE GGEIELFDGE VNVKRPMKDE

951 THFEVVESGR YIILLLGKAL SVVWDRHLSI SVVLKQTYQE KVCGLCGNFD

1001 GIQNNDLTSS NLQVEEDPVD FGNSWKVSSQ CADTRKVPLD SSPATCHNNI

1051 MKQTMVDSSC RILTSDVFQD CNKLVDPEPY LDVCIYDTCS CESIGDCAAF

1101 CDTIAAYAHV CAQHGKVVTW RTATLCPQSC EERNLRENGY EAEWRYNSCA

1151 PACQVTCQHP EPLACPVQCV EGCHAHCPPG KILDELLQTC VDPEDCPVCE

1201 VAGRRFASGK KVTLNPSDPE HCQICHCDVV NLTCEACQEP ISGAPTSESA

1251 TPESGPGSEP ATSGSETPGT SESATPESGP GSEPATSGSE TPGTSESATP

1301 ESGPGTSTEP SEGSAPGSPA GSPTSTEEGT SESATPESGP GSEPATSGSE

1351 TPGTSESATP ESGPGSPAGS PTSTEEGSPA GSPTSTEEGA SISDKNTGDY

1401 YEDSYEDISA YLLSKNNAIE PRSFSDKTHT CPPCPAPELL GGPSVFLFPP

1451 KPKDTLMISR TPEVTCVVVD VSHEDPEVKF NWYVDGVEVH NAKTKPREEQ

1501 YNSTYRVVSV LTVLHQDWLN GKEYKCKVSN KALPAPIEKT ISKAKGQPRE

1551 PQVYTLPPSR DELTKNQVSL TCLVKGFYPS DIAVEWESNG QPENNYKTTP

1601 PVLDSDGSFF LYSKLTVDKS RWQQGNVFSC SVMHEALHNH YTQKSLSLSP

1651 GK* pSYN VWF062 nucleotide sequence (encoding VWF D'D3-Fc
with no thrombin site in the linker)
                                                  (SEQ ID NO: 198)
   1 ATGATTCCTG CCAGATTTGC CGGGGTGCTG CTTGCTCTGG CCCTCATTTT

51 GCCAGGGACC CTTTGTGCAG AAGGAACTCG CGGCAGGTCA TCCACGGCCC

101 GATGCAGCCT TTTCGGAAGT GACTTCGTCA ACACCTTTGA TGGGAGCATG

151 TACAGCTTTG CGGGATACTG CAGTTACCTC CTGGCAGGGG GCTGCCAGAA

201 ACGCTCCTTC TCGATTATTG GGACTTCCA GAATGGCAAG AGAGTGAGCC

251 TCTCCGTGTA TCTTGGGGAA TTTTTTGACA TCCATTTGTT TGTCAATGGT

301 ACCGTGACAC AGGGGGACCA AAGAGTCTCC ATGCCCTATG CCTCCAAAGG

351 GCTGTATCTA GAAACTGAGG CTGGGTACTA CAAGCTGTCC GGTGAGGCCT

401 ATGGCTTTGT GGCCAGGATC GATGGCAGCG GCAACTTTCA AGTCCTGCTG

451 TCAGACAGAT ACTTCAACAA GACCTGCGGG CTGTGTGGCA ACTTTAACAT

501 CTTTGCTGAA GATGACTTTA TGACCCAAGA AGGGACCTTG ACCTCGGACC

551 CTTATGACTT TGCCAACTCA TGGGCTCTGA GCAGTGGAGA ACAGTGGTGT

601 GAACGGGCAT CTCCTCCCAG CAGCTCATGC AACATCTCCT CTGGGGAAAT

651 GCAGAAGGGC CTGTGGGAGC AGTGCCAGCT TCTGAAGAGC ACCTCGGTGT

701 TTGCCCGCTG CCACCCTCTG GTGGACCCCG AGCCTTTTGT GGCCCTGTGT

751 GAGAAGACTT TGTGTGAGTG TGCTGGGGGG CTGGAGTGCG CCTGCCCTGC

801 CCTCCTGGAG TACGCCCGGA CCTGTGCCCA GGAGGGAATG GTGCTGTACG

851 GCTGGACCGA CCACAGCGCG TGCAGCCCAG TGTGCCCTGC TGGTATGGAG

901 TATAGGCAGT GTGTGTCCCC TTGCGCCAGG ACCTGCCAGA GCCTGCACAT

951 CAATGAAATG TGTCAGGAGC GATGCGTGGA TGGCTGCAGC TGCCCTGAGG

1001 GACAGCTCCT GGATGAAGGC CTCTGCGTGG AGAGCACCGA GTGTCCCTGC

1051 GTGCATTCCG GAAAGCGCTA CCCTCCCGGC ACCTCCCTCT CTCGAGACTG
```

-continued

```
1101 CAACACCTGC ATTTGCCGAA ACAGCCAGTG GATCTGCAGC AATGAAGAAT
1151 GTCCAGGGGA GTGCCTTGTC ACTGGTCAAT CCCACTTCAA GAGCTTTGAC
1201 AACAGATACT TCACCTTCAG TGGGATCTGC CAGTACCTGC TGGCCCGGGA
1251 TTGCCAGGAC CACTCCTTCT CCATTGTCAT TGAGACTGTC CAGTGTGCTG
1301 ATGACCGCGA CGCTGTGTGC ACCCGCTCCG TCACCGTCCG GCTGCCTGGC
1351 CTGCACAACA GCCTTGTGAA ACTGAAGCAT GGGGCAGGAG TTGCCATGGA
1401 TGGCCAGGAC ATCCAGCTCC CCCTCCTGAA AGGTGACCTC CGCATCCAGC
1451 ATACAGTGAC GGCCTCCGTG CGCCTCAGCT ACGGGGAGGA CCTGCAGATG
1501 GACTGGGATG GCCGCGGGAG GCTGCTGGTG AAGCTGTCCC CCGTCTATGC
1551 CGGGAAGACC TGCGGCCTGT GTGGGAATTA CAATGGCAAC CAGGGCGACG
1601 ACTTCCTTAC CCCCTCTGGG CTGGCGGAGC CCCGGGTGGA GGACTTCGGG
1651 AACGCCTGGA AGCTGCACGG GGACTGCCAG GACCTGCAGA AGCAGCACAG
1701 CGATCCCTGC GCCCTCAACC CGCGCATGAC CAGGTTCTCC GAGGAGGCGT
1751 GCGCGGTCCT GACGTCCCCC ACATTCGAGG CCTGCCATCG TGCCGTCAGC
1801 CCGCTGCCCT ACCTGCGGAA CTGCCGCTAC GACGTGTGCT CCTGCTCGGA
1851 CGGCCGCGAG TGCCTGTGCG GCGCCCTGGC CAGCTATGCC GCGGCCTGCG
1901 CGGGGAGAGG CGTGCGCGTC GCGTGGCGCG AGCCAGGCCG CTGTGAGCTG
1951 AACTGCCCGA AAGGCCAGGT GTACCTGCAG TGCGGGACCC CCTGCAACCT
2001 GACCTGCCGC TCTCTCTCTT ACCCGGATGA GGAATGCAAT GAGGCCTGCC
2051 TGGAGGGCTG CTTCTGCCCC CCAGGGCTCT ACATGGATGA GAGGGGGGAC
2101 TGCGTGCCCA AGGCCCAGTG CCCCTGTTAC TATGACGGTG AGATCTTCCA
2151 GCCAGAAGAC ATCTTCTCAG ACCATCACAC CATGTGCTAC TGTGAGGATG
2201 GCTTCATGCA CTGTACCATG AGTGGAGTCC CCGGAAGCTT GCTGCCTGAC
2251 GCTGTCCTCA GCAGTCCCCT GTCTCATCGC AGCAAAAGGA GCCTATCCTG
2301 TCGGCCCCCC ATGGTCAAGC TGGTGTGTCC CGCTGACAAC CTGCGGGCTG
2351 AAGGGCTCGA GTGTACCAAA ACGTGCCAGA ACTATGACCT GGAGTGCATG
2401 AGCATGGGCT GTGTCTCTGG CTGCCTCTGC CCCCCGGGCA TGGTCCGGCA
2451 TGAGAACAGA TGTGTGGCCC TGGAAAGGTG TCCCTGCTTC CATCAGGGCA
2501 AGGAGTATGC CCCTGGAGAA ACAGTGAAGA TTGGCTGCAA CACTTGTGTC
2551 TGTCGGGACC GGAAGTGGAA CTGCACAGAC CATGTGTGTG ATGCCACGTG
2601 CTCCACGATC GGCATGGCCC ACTACCTCAC CTTCGACGGG CTCAAATACC
2651 TGTTCCCCGG GGAGTGCCAG TACGTTCTGG TGCAGGATTA CTGCGGCAGT
2701 AACCCTGGGA CCTTTCGGAT CCTAGTGGGG AATAAGGGAT GCAGCCACCC
2751 CTCAGTGAAA TGCAAGAAAC GGGTCACCAT CCTGGTGGAG GGAGGAGAGA
2801 TTGAGCTGTT TGACGGGGAG GTGAATGTGA AGAGGCCCAT GAAGGATGAG
2851 ACTCACTTTG AGGTGGTGGA GTCTGGCCGG TACATCATTC TGCTGCTGGG
2901 CAAAGCCCTC TCCGTGGTCT GGGACCGCCA CCTGAGCATC TCCGTGGTCC
2951 TGAAGCAGAC ATACCAGGAG AAAGTGTGTG GCCTGTGTGG GAATTTTGAT
3001 GGCATCCAGA ACAATGACCT CACCAGCAGC AACCTCCAAG TGGAGGAAGA
3051 CCCTGTGGAC TTTGGGAACT CCTGGAAAGT GAGCTCGCAG TGTGCTGACA
```

```
3101 CCAGAAAAGT GCCTCTGGAC TCATCCCCTG CCACCTGCCA TAACAACATC
3151 ATGAAGCAGA CGATGGTGGA TTCCTCCTGT AGAATCCTTA CCAGTGACGT
3201 CTTCCAGGAC TGCAACAAGC TGGTGGACCC CGAGCCATAT CTGGATGTCT
3251 GCATTTACGA CACCTGCTCC TGTGAGTCCA TTGGGGACTG CGCCGCATTC
3301 TGCGACACCA TTGCTGCCTA TGCCCACGTG TGTGCCCAGC ATGGCAAGGT
3351 GGTGACCTGG AGGACGGCCA CATTGTGCCC CCAGAGCTGC GAGGAGAGGA
3401 ATCTCCGGGA GAACGGGTAT GAGGCTGAGT GGCGCTATAA CAGCTGTGCA
3451 CCTGCCTGTC AAGTCACGTG TCAGCACCCT GAGCCACTGG CCTGCCCTGT
3501 GCAGTGTGTG GAGGGCTGCC ATGCCCACTG CCCTCCAGGG AAAATCCTGG
3551 ATGAGCTTTT GCAGACCTGC GTTGACCCTG AAGACTGTCC AGTGTGTGAG
3601 GTGGCTGGCC GGCGTTTTGC CTCAGGAAAG AAAGTCACCT TGAATCCCAG
3651 TGACCCTGAG CACTGCCAGA TTTGCCACTG TGATGTTGTC AACCTCACCT
3701 GTGAAGCCTG CCAGGAGCCG ATATCGGGCG CGCCAACATC AGAGAGCGCC
3751 ACCCCTGAAA GTGGTCCCGG GAGCGAGCCA GCCACATCTG GGTCGGAAAC
3801 GCCAGGCACA AGTGAGTCTG CAACTCCCGA GTCGGACCT GGCTCCGAGC
3851 CTGCCACTAG CGGCTCCGAG ACTCCGGGAA CTTCCGAGAG CGCTACACCA
3901 GAAAGCGGAC CCGGAACCAG TACCGAACCT AGCGAGGGCT CTGCTCCGGG
3951 CAGCCCAGCC GGCTCTCCTA CATCCACGGA GGAGGGCACT TCCGAATCCG
4001 CCACCCCGGA GTCAGGGCCA GGATCTGAAC CCGCTACCTC AGGCAGTGAG
4051 ACGCCAGGAA CGAGCGAGTC CGCTACACCG GAGAGTGGGC CAGGGAGCCC
4101 TGCTGGATCT CCTACGTCCA CTGAGGAAGG GTCACCAGCG GGCTCGCCCA
4151 CCAGCACTGA AGAAGGTGCC TCGAGCGACA AAACTCACAC ATGCCCACCG
4201 TGCCCAGCTC CAGAACTCCT GGGCGGACCG TCAGTCTTCC TCTTCCCCCC
4251 AAAACCCAAG GACACCCTCA TGATCTCCCG GACCCCTGAG GTCACATGCG
4301 TGGTGGTGGA CGTGAGCCAC GAAGACCCTG AGGTCAAGTT CAACTGGTAC
4351 GTGGACGGCG TGGAGGTGCA TAATGCCAAG ACAAAGCCGC GGGAGGAGCA
4401 GTACAACAGC ACGTACCGTG TGGTCAGCGT CCTCACCGTC CTGCACCAGG
4451 ACTGGCTGAA TGGCAAGGAG TACAAGTGCA AGGTCTCCAA CAAAGCCCTC
4501 CCAGCCCCCA TCGAGAAAAC CATCTCCAAA GCCAAAGGGC AGCCCCGAGA
4551 ACCACAGGTG TACACCCTGC CCCCATCCCG GGATGAGCTG ACCAAGAACC
4601 AGGTCAGCCT GACCTGCCTG GTCAAAGGCT TCTATCCCAG CGACATCGCC
4651 GTGGAGTGGG AGAGCAATGG GCAGCCGGAG AACAACTACA AGACCACGCC
4701 TCCCGTGTTG GACTCCGACG GCTCCTTCTT CCTCTACAGC AAGCTCACCG
4751 TGGACAAGAG CAGGTGGCAG CAGGGGAACG TCTTCTCATG CTCCGTGATG
4801 CATGAGGCTC TGCACAACCA CTACACGCAG AAGAGCCTCT CCCTGTCTCC
4851 GGGTAAATGA
``` pSYN VWF062 protein sequence (VWF D'D3-Fc with no thrombin site in the linker)

(SEQ ID NO: 199)

```
 1 MIPARFAGVL LALALILPGT LCAEGTRGRS STARCSLFGS DFVNTFDGSM
51 YSFAGYCSYL LAGGCQKRSF SIIGDFQNGK RVSLSVYLGE FFDIHLFVNG
```

```
 101  TVTQGDQRVS MPYASKGLYL EIEAGYYKLS GEAYGFVARI DGSGNFQVLL

151  SDRYFNKTCG LCGNFNIFAE DDFMTQEGTL TSDPYDFANS WALSSGEQWC

201  ERASPPSSSC NISSGEMQKG LWEQCQLLKS TSVFARCHPL VDPEPFVALC

251  EKTLCECAGG LECACPALLE YARTCAQEGM VLYGWTDHSA CSPVCPAGME

301  YRQCVSPCAR TCQSLHINEM CQERCVDGCS CPEGQLLDEG LCVESTECPC

351  VHSGKRYPPG TSLSRDCNTC ICRNSQWICS NEECPGECLV TGQSHFKSFD

401  NRYFTFSGIC QYLLARDCQD HSFSIVIETV QCADDRDAVC TRSVTVRLPG

451  LHNSLVKLKH GAGVAMDGQD IQLPLLKGDL RIQHTVTASV RLSYGEDLQM

501  DWDGRGRLLV KLSPVYAGKT CGLCGNYNGN QGDDFLTPSG LAEPRVEDFG

551  NAWKLHGDCQ DLQKQHSDPC ALNPRMTRFS EEACAVLTSP TFEACHRAVS

601  PLPYLRNCRY DVCSCSDGRE CLCGALASYA ACAGRGVRV  AWREPGRCEL

651  NCPKGQVYLQ CGTPCNLTCR SLSYPDEECN EACLEGCFCP PGLYMDERGD

701  CVPKAQCPCY YDGEIFQPED IFSDHHTMCY CEDGFMHCTM SGVPGSLLPD

751  AVLSSPLSHR SKRSLSCRPP MVKLVCPADN LRAEGLECTK TCQNYDLECM

801  SMGCVSGCLC PPGMVRHENR CVALERCPCF HQGKEYAPGE TVKIGCNTCV

851  CRDRKWNCTD HVCDATCSTI GMAHYLTFDG LKYLFPGECQ YVLVQDYCGS

901  NPGTFRILVG NKGCSHPSVK CKKRVTILVE GGEIELFDGE VNVKRPMKDE

951  THFEVVESGR YIILLLGKAL SVVWDRHLSI SVVLKQTYQE KVCGLCGNFD

1001  GIQNNDLTSS NLQVEEDPVD FGNSWKVSSQ CADTRKVPLD SSPATCHNNI

1051  MKQTMVDSSC RILTSDVFQD CNKLVDPEPY LDVCIYDTCS CESIGDCAAF

1101  CDTIAAYAHV CAQHGKVVTW RTATLCPQSC EERNLRENGY EAEWRYNSCA

1151  PACQVTCQHP EPLACPVQCV EGCHAHCPPG KILDELLQTC VDPEDCPVCE

1201  VAGRRFASGK KVTLNPSDPE HCQICHCDVV NLTCEACQEP ISGAPTSESA

1251  TPESGPGSEP ATSGSETPGT SESATPESGP GSEPATSGSE TPGTSESATP

1301  ESGPGTSTEP SEGSAPGSPA GSPTSIEEGT SESATPESGP GSEPATSGSE

1351  TPGTSESATP ESGPGSPAGS PTSTEEGSPA GSPTSTEEGA SSDKTHTCPP

1401  CPAPELLGGP SVFLFPPKPK DTLMISRTPE VTCVVVDVSH EDPEVKFNWY

1451  VDGVEVHNAK TKPREEQYNS TYRVVSVLTV LHQDWLNGKE YKCKVSNKAL

1501  PAPIEKTISK AKGQPREPQV YTLPPSRDEL TKNQVSLTCL VKGFYPSDIA

1551  VEWESNGQPE NNYKTTPPVL DSDGSFFLYS KLTVDKSRWQ QGNVFSCSVM

1601  HEALHNHYTQ KSLSLSPGK*
``` pSYN VWF073 nucleotide sequence-(encoding VWFD1D2D'D3-144
AE XTEN-FVIII truncated a2 thrombin site-Fc)

(SEQ ID NO: 174)

```
   1 ATGATTCCTG CCAGATTTGC CGGGGTGCTG CTTGCTCTGG CCCTCATTTT

51 GCCAGGGACC CTTTGTGCAG AAGGAACTCG CGGCAGGTCA TCCACGGCCC

101 GATGCAGCCT TTTCGGAAGT GACTTCGTCA ACACCTTTGA TGGGAGCATG

151 TACAGCTTTG CGGGATACTG CAGTTACCTC CTGGCAGGGG GCTGCCAGAA

201 ACGCTCCTTC TCGATTATTG GGGACTTCCA GAATGGCAAG AGAGTGAGCC

251 TCTCCGTGTA TCTTGGGGAA TTTTTTGACA TCCATTTGTT TGTCAATGGT

301 ACCGTGACAC AGGGGGACCA AAGAGTCTCC ATGCCCTATG CCTCCAAAGG
```

```
 351 GCTGTATCTA GAAACTGAGG CTGGGTACTA CAAGCTGTCC GGTGAGGCCT

401 ATGGCTTTGT GGCCAGGATC GATGGCAGCG GCAACTTTCA AGTCCTGCTG

451 TCAGACAGAT ACTTCAACAA GACCTGCGGG CTGTGTGGCA ACTTTAACAT

501 CTTTGCTGAA GATGACTTTA TGACCCAAGA AGGGACCTTG ACCTCGGACC

551 CTTATGACTT TGCCAACTCA TGGGCTCTGA GCAGTGGAGA ACAGTGGTGT

601 GAACGGGCAT CTCCTCCCAG CAGCTCATGC AACATCTCCT CTGGGAAAT

651 GCAGAAGGGC CTGTGGGAGC AGTGCCAGCT TCTGAAGAGC ACCTCGGTGT

701 TTGCCCGCTG CCACCCTCTG GTGGACCCCG AGCCTTTTGT GGCCCTGTGT

751 GAGAAGACTT TGTGTGAGTG TGCTGGGGGG CTGGAGTGCG CCTGCCCTGC

801 CCTCCTGGAG TACGCCCGGA CCTGTGCCCA GGAGGGAATG GTGCTGTACG

851 GCTGGACCGA CCACAGCGCG TGCAGCCCAG TGTGCCCTGC TGGTATGGAG

901 TATAGGCAGT GTGTGTCCCC TTGCGCCAGG ACCTGCCAGA GCCTGCACAT

951 CAATGAAATG TGTCAGGAGC GATGCGTGGA TGGCTGCAGC TGCCCTGAGG

1001 GACAGCTCCT GGATGAAGGC CTCTGCGTGG AGAGCACCGA GTGTCCCTGC

1051 GTGCATTCCG GAAAGCGCTA CCCTCCCGGC ACCTCCCTCT CTCGAGACTG

1101 CAACACCTGC ATTTGCCGAA ACAGCCAGTG GATCTGCAGC AATGAAGAAT

1151 GTCCAGGGGA GTGCCTTGTC ACTGGTCAAT CCCACTTCAA GAGCTTTGAC

1201 AACAGATACT TCACCTTCAG TGGGATCTGC CAGTACCTGC TGGCCCGGGA

1251 TTGCCAGGAC CACTCCTTCT CCATTGTCAT TGAGACTGTC CAGTGTGCTG

1301 ATGACCGCGA CGCTGTGTGC ACCCGCTCCG TCACCGTCCG GCTGCCTGGC

1351 CTGCACAACA GCCTTGTGAA ACTGAAGCAT GGGGCAGGAG TTGCCATGGA

1401 TGGCCAGGAC ATCCAGCTCC CCCTCCTGAA AGGTGACCTC CGCATCCAGC

1451 ATACAGTGAC GGCCTCCGTG CGCCTCAGCT ACGGGGAGGA CCTGCAGATG

1501 GACTGGGATG GCCGCGGGAG GCTGCTGGTG AAGCTGTCCC CCGTCTATGC

1551 CGGGAAGACC TGCGGCCTGT GTGGGAATTA CAATGGCAAC CAGGGCGACG

1601 ACTTCCTTAC CCCCTCTGGG CTGGCGGAGC CCCGGGTGGA GGACTTCGGG

1651 AACGCCTGGA AGCTGCACGG GGACTGCCAG GACCTGCAGA AGCAGCACAG

1701 CGATCCCTGC GCCCTCAACC CGCGCATGAC CAGGTTCTCC GAGGAGGCGT

1751 GCGCGGTCCT GACGTCCCCC ACATTCGAGG CCTGCCATCG TGCCGTCAGC

1801 CCGCTGCCCT ACCTGCGGAA CTGCCGCTAC GACGTGTGCT CCTGCTCGGA

1851 CGGCCGCGAG TGCCTGTGCG GCGCCCTGGC CAGCTATGCC GCGGCCTGCG

1901 CGGGGAGAGG CGTGCGCGTC GCGTGGCGCG AGCCAGGCCG CTGTGAGCTG

1951 AACTGCCCGA AAGGCCAGGT GTACCTGCAG TGCGGGACCC CCTGCAACCT

2001 GACCTGCCGC TCTCTCTCTT ACCCGGATGA GGAATGCAAT GAGGCCTGCC

2051 TGGAGGGCTG CTTCTGCCCC CCAGGGCTCT ACATGGATGA GAGGGGGGAC

2101 TGCGTGCCCA AGGCCCAGTG CCCCTGTTAC TATGACGGTG AGATCTTCCA

2151 GCCAGAAGAC ATCTTCTCAG ACCATCACAC CATGTGCTAC TGTGAGGATG

2201 GCTTCATGCA CTGTACCATG AGTGGAGTCC CCGGAAGCTT GCTGCCTGAC

2251 GCTGTCCTCA GCAGTCCCCT GTCTCATCGC AGCAAAAGGA GCCTATCCTG
```

```
2301  TCGGCCCCCC ATGGTCAAGC TGGTGTGTCC CGCTGACAAC CTGCGGGCTG
2351  AAGGGCTCGA GTGTACCAAA ACGTGCCAGA ACTATGACCT GGAGTGCATG
2401  AGCATGGGCT GTGTCTCTGG CTGCCTCTGC CCCCCGGGCA TGGTCCGGCA
2451  TGAGAACAGA TGTGTGGCCC TGGAAAGGTG TCCCTGCTTC CATCAGGGCA
2501  AGGAGTATGC CCCTGGAGAA ACAGTGAAGA TTGGCTGCAA CACTTGTGTC
2551  TGTCGGGACC GGAAGTGGAA CTGCACAGAC CATGTGTGTG ATGCCACGTG
2601  CTCCACGATC GGCATGGCCC ACTACCTCAC CTTCGACGGG CTCAAATACC
2651  TGTTCCCCGG GGAGTGCCAG TACGTTCTGG TGCAGGATTA CTGCGGCAGT
2701  AACCCTGGGA CCTTTCGGAT CCTAGTGGGG AATAAGGGAT GCAGCCACCC
2751  CTCAGTGAAA TGCAAGAAAC GGGTCACCAT CCTGGTGGAG GGAGGAGAGA
2801  TTGAGCTGTT TGACGGGGAG GTGAATGTGA AGAGGCCCAT GAAGGATGAG
2851  ACTCACTTTG AGGTGGTGGA GTCTGGCCGG TACATCATTC TGCTGCTGGG
2901  CAAAGCCCTC TCCGTGGTCT GGGACCGCCA CCTGAGCATC TCCGTGGTCC
2951  TGAAGCAGAC ATACCAGGAG AAAGTGTGTG GCCTGTGTGG GAATTTTGAT
3001  GGCATCCAGA ACAATGACCT CACCAGCAGC AACCTCCAAG TGGAGGAAGA
3051  CCCTGTGGAC TTTGGGAACT CCTGGAAAGT GAGCTCGCAG TGTGCTGACA
3101  CCAGAAAAGT GCCTCTGGAC TCATCCCCTG CCACCTGCCA TAACAACATC
3151  ATGAAGCAGA CGATGGTGGA TTCCTCCTGT AGAATCCTTA CCAGTGACGT
3201  CTTCCAGGAC TGCAACAAGC TGGTGGACCC CGAGCCATAT CTGGATGTCT
3251  GCATTTACGA CACCTGCTCC TGTGAGTCCA TTGGGGACTG CGCCGCATTC
3301  TGCGACACCA TTGCTGCCTA TGCCCACGTG TGTGCCCAGC ATGGCAAGGT
3351  GGTGACCTGG AGGACGGCCA CATTGTGCCC CCAGAGCTGC GAGGAGAGGA
3401  ATCTCCGGGA GAACGGGTAT GAGGCTGAGT GGCGCTATAA CAGCTGTGCA
3451  CCTGCCTGTC AAGTCACGTG TCAGCACCCT GAGCCACTGG CCTGCCCTGT
3501  GCAGTGTGTG GAGGGCTGCC ATGCCCACTG CCCTCCAGGG AAAATCCTGG
3551  ATGAGCTTTT GCAGACCTGC GTTGACCCTG AAGACTGTCC AGTGTGTGAG
3601  GTGGCTGGCC GGCGTTTTGC CTCAGGAAAG AAAGTCACCT TGAATCCCAG
3651  TGACCCTGAG CACTGCCAGA TTTGCCACTG TGATGTTGTC AACCTCACCT
3701  GTGAAGCCTG CCAGGAGCCG GGCGCGCCAA CATCAGAGAG CGCCACCCCT
3751  GAAAGTGGTC CCGGGAGCGA GCCAGCCACA TCTGGGTCGG AAACGCCAGG
3801  CACAAGTGAG TCTGCAACTC CCGAGTCCGG ACCTGGCTCC GAGCCTGCCA
3851  CTAGCGGCTC CGAGACTCCG GGAACTTCCG AGAGCGCTAC ACCAGAAAGC
3901  GGACCCGGAA CCAGTACCGA ACCTAGCGAG GGCTCTGCTC CGGGCAGCCC
3951  AGCCGGCTCT CCTACATCCA CGGAGGAGGG CACTTCCGAA TCCGCCACCC
4001  CGGAGTCAGG GCCAGGATCT GAACCCGCTA CCTCAGGCAG TGAGACGCCA
4051  GGAACGAGCG AGTCCGCTAC ACCGGAGAGT GGGCCAGGGA GCCCTGCTGG
4101  ATCTCCTACG TCCACTGAGG AAGGGTCACC AGCGGGCTCG CCCACCAGCA
4151  CTGAAGAAGG TGCCTCGAGC GGCGGTGGAG GATCCGGTGG CGGGGGATCC
4201  GGTGGCGGGG GATCCGGTGG CGGGGGATCC GGTGGCGGGG GATCCGGTGG
4251  CGGGGGATCC ATTGAACCAA GAAGCTTCTC TGGCAGCGGA GGCGACAAAA
```

```
4301 CTCACACATG CCCACCGTGC CCAGCTCCAG AACTCCTGGG CGGACCGTCA

4351 GTCTTCCTCT TCCCCCCAAA ACCCAAGGAC ACCCTCATGA TCTCCCGGAC

4401 CCCTGAGGTC ACATGCGTGG TGGTGGACGT GAGCCACGAA GACCCTGAGG

4451 TCAAGTTCAA CTGGTACGTG GACGGCGTGG AGGTGCATAA TGCCAAGACA

4501 AAGCCGCGGG AGGAGCAGTA CAACAGCACG TACCGTGTGG TCAGCGTCCT

4551 CACCGTCCTG CACCAGGACT GGCTGAATGG CAAGGAGTAC AAGTGCAAGG

4601 TCTCCAACAA AGCCCTCCCA GCCCCCATCG AGAAAACCAT CTCCAAAGCC

4651 AAAGGGCAGC CCCGAGAACC ACAGGTGTAC ACCCTGCCCC CATCCCGGGA

4701 TGAGCTGACC AAGAACCAGG TCAGCCTGAC CTGCCTGGTC AAAGGCTTCT

4751 ATCCCAGCGA CATCGCCGTG GAGTGGGAGA GCAATGGGCA GCCGGAGAAC

4801 AACTACAAGA CCACGCCTCC CGTGTTGGAC TCCGACGGCT CCTTCTTCCT

4851 CTACAGCAAG CTCACCGTGG ACAAGAGCAG GTGGCAGCAG GGGAACGTCT

4901 TCTCATGCTC CGTGATGCAT GAGGCTCTGC ACAACCACTA CACGCAGAAG

4951 AGCCTCTCCC TGTCTCCGGG TAAATGA
``` pSYN VWF073 protein sequence-(VWFD1D2D'D3-144 AE XTEN-truncated a2 thrombin site-Fc)

(SEQ ID NO: 175)

```
   1 MIPARFAGVL LALALILPGT LCAEGTRGRS STARCSLFGS DFVNTFDGSM

51 YSFAGYCSYL LAGGCQKRSF SIIGDFQNGK RVSLSVYLGE FFDIHLFVNG

101 TVTQGDQRVS MPYASKGLYL ETEAGYYKLS GEAYGFVARI DGSGNFQVLL

151 SDRYFNKTCG LCGNFNIFAE DDFMTQEGTL TSDPYDFANS WALSSGEQWC

201 ERASPPSSSC NISSGEMQKG LWEQCQLLKS TSVFARCHPL VDPEPFVALC

251 EKTLCECAGG LECACPALLE YARTCAQEGM VLYGWTDHSA CSPVCPAGME

301 YRQCVSPCAR TCQSLHINEM CQERCVDGCS CPEGQLLDEG LCVESTECPC

351 VHSGKRYPPG TSLSRDCNTC ICRNSQWICS NEECPGECLV TGQSHFKSFD

401 NRYFTFSGIC QYLLARDCQD HSFSIVIETV QCADDRDAVC TRSVTVRLPG

451 LHNSLVKLKH GAGVAMDGQD IQLPLLKGDL RIQHTVTASV RLSYGEDLQM

501 DWDGRGRLLV KLSPVYAGKT CGLCGNYNGN QGDDFLTPSG LAEPRVEDFG

551 NAWKLHGDCQ DLQKQHSDPC ALNPRMTRFS EEACAVLTSP TFEACHRAVS

601 PLPYLRNCRY DVCSCSDGRE CLCGALASYA AACAGRGVRV AWREPGRCEL

651 NCPKGQVYLQ CGTPCNLTCR SLSYPDEECN EACLEGCFCP PGLYMDERGD

701 CVPKAQCPCY YDGEIFQPED IFSDHHTMCY CEDGFMHCTM SGVPGSLLPD

751 AVLSSPLSHR SKRSLSCRPP MVKLVCPADN LRAEGLECTK TCQNYDLECM

801 SMGCVSGCLC PPGMVRHENR CVALERCPCF HQGKEYAPGE TVKIGCNTCV

851 CRDRKWNCTD HVCDATCSTI GMAHYLTFDG LKYLFPGECQ YVLVQDYCGS

901 NPGTFRILVG NKGCSHPSVK CKKRVTILVE GGEIELFDGE VNVKRPMKDE

951 THFEVVESGR YIILLLGKAL SVVWDRHLSI SVVLKQTYQE KVCGLCGNFD

1001 GIQNNDLTSS NLQVEEDPVD FGNSWKVSSQ CADTRKVPLD SSPATCHNNI

1051 MKQTMVDSSC RILTSDVFQD CNKLVDPEPY LDVCIYDTCS CESIGDCAAF

1101 CDTIAAYAHV CAQHGKVVTW RTATLCPQSC EERNLRENGY EAEWRYNSCA

1151 PACQVTCQHP EPLACPVQCV EGCHAHCPPG KILDELLQTC VDPEDCPVCE
```

-continued

```
1201  VAGRRFASGK KVTLNPSDPE HCQICHCDVV NLTCEACQEP GAPTSESATP

1251  ESGPGSEPAT SGSETPGTSE SATPESGPGS EPATSGSETP GTSESATPES

1301  GPGTSIEPSE GSAPGSPAGS PTSIEEGTSE SATPESGPGS EPATSGSETP

1351  GTSESATPES GPGSPAGSPT STEEGSPAGS PTSIEEGASS GGGGSGGGGS

1401  GGGGSGGGGS GGGGSGGGGS IEPRSFSGSG GDKTHTCPPC PAPELLGGPS

1451  VFLFPPKPKD TLMISRTPEV TCVVVDVSHE DPEVKFNWYV DGVEVHNAKT

1501  KPREEQYNST YRVVSVLTVL HQDWLNGKEY KCKVSNKALP APIEKTISKA

1551  KGQPREPQVY TLPPSRDELT KNQVSLTCLV KGFYPSDIAV EWESNGQPEN

1601  NYKTTPPVLD SDGSFFLYSK LTVDKSRWQQ GNVFSCSVMH EALHNHYTQK

1651  SLSLSPGK*
```

TABLE 18

Exemplary Chimeric Polypeptide Sequences

FVIII-XTEN-Fc: SEQ ID NO: 201
TRRYYLGAVELSWDYMQSDLGELPVDARFPPRVPKSFPFNTSVVYKKTLFVEFTDHLFNIAKPRPPWMGLLGP
TIQAEVYDTVVITLKNMASHPVSLHAVGVSYWKASEGAEYDDQTSQREKEDDKVFPGGSHTYVWQVLKENGPM
ASDPLCLTYSYLSHVDLVKDLNSGLIGALLVCREGSLAKEKTQTLHKFILLFAVFDEGKSWHSETKNSLMQDR
DAASARAWPKMHTVNGYVNRSLPGLIGCHRKSVYWHVIGMGTTPEVHSIFLEGHTFLVRNHRQASLEISPITF
LTAQTLLMDLGQFLLFCHISSHQHDGMEAYVKVDSCPEEPQLRMKNNEEAEDYDDDLTDSEMDVVRFDDDNSP
FIQIRSVAKKHPKTWVHYIAAEEEDWDYAPLVLAPDDRSYKSQYLNNGPQRIGRKYKKVRFMAYTDETFKTRE
AIQHESGILGPLLYGEVGDTLLIIFKNQASRPYNIYPHGITDVRPLYSRRLPKGVKHLKDFPILPGEIFKYKW
TVTVEDGPTKSDPRCLTRYYSSFVNMERDLASGLIGPLLICYKESVDQRGNQIMSDKRNVILFSVFDENRSWY
LTENIQRFLPNPAGVQLEDPEFQASNIMHSINGYVFDSLQLSVCLHEVAYWYILSIGAQTDFLSVFFSGYTFK
HKMVYEDTLTLFPFSGETVFMSMENPGLWILGCHNSDFRNRGMTALLKVSSCDKNTGDYYEDSYEDISAYLLS
KNNAIEPRSFSQNGTSESATPESGPGSEPATSGSETPGTSESATPESGPGSEPATSGSETPGTSESATPESGP
GTSTEPSEGSAPGSPAGSPTSTEEGTSESATPESGPGSEPATSGSETPGTSESATPESGPGSPAGSPTSTEEG
SPAGSPTSTEEGTSTEPSEGSAPGTSESATPESGPGTSESATPESGPGTSESATPESGPGTSESATPSGSETPGS
EPATSGSETPGSPAGSPTSTEEGTSTPESEGSAPGTSTEPSEGSAPGSEPATSGSETPGTSESATPESGPGTS
TEPSEGSAPASSEITRTTLQSDQEEIDYDDTISVEMKKEDFDIYDEDENQSPRSFQKKTRHYFIAAVERLWDY
GMSSSPHVLRNRAQSGSVPQFKKVVFQEFTDGSFTQPLYRGELNEHLGLLGPYIRAEVEDNIMVTFRNQASRP
YSFYSSLISYEEDQRQGAEPRKNFVKPNETKTYFWKVQHHMAPTKDEFDCKAWAYFSDVDLEKDVHSGLIGPL
LVCHTNTLNPAHGRQVTVQEFALFFTIFDETKSWYFTENMERNCRAPCNIQMEDPTFKENYRFHAINGYIMDT
LPGLVMAQDQRIRWYLLSMGSNENIHSIHFSGHVFTVRKKEEYKMALYNLYPGVFETVEMLPSKAGIWRVECL
IGEHLHAGMSTLFLVYSNKCQTPLGMASGHIRDFQITASGQYGQWAPKLARLHYSGSINAWSTKEPFSWIKVD
LLAPMIIHGIKTQGARQKFSSLYISQFIIMYSLDGKKWQTYRGNSTLMVFFGNVDSSGIKHNIFNPPIIAR
YIRLHPTHYSIRSTLRMELMGCDLNSCSMPLGMESKAISDAQITASSYFTNMFATWSPSKARLHLQGRSNAWR
PQVNNPKEWLQVDFQKTMKVTGVTTQGVKSLLTSMYVKEFLISSSQDGHQWTLFFQNGKVKVFQGNQDSFTPV
VNSLDPPLLTRYLRIHPQSWVHQIALRMEVLGCEAQDLYDKTHTCPPCPAPELLGGPSVFLFPPKPKDTLMIS
RTPEVTCVVVDVSHEDPEVKFNWYVDGVEVHNAKTKPREEQYNSTYRVVSVLTVLHQDWLNGKEYKCKVSNKA
LPAPIEKTISKAKGQPREPQVYTLPPSRDELTKNQVSLTCLVKGFYPSDIAVEWESNGQPENNYKTTPPVLDS
DGSFFLYSKLTVDKRRWQQGNVFSCSVMHEALHNHYTQKSLSLSPG

VWF(D'D3)-XTEN-a2 Linker-Fc: SEQ ID NO: 202
SLSCRPPMVKLVCPADNLRAEGLECTKTCQNYDLECMSMGCVSGCLCPPGMVRHENRCVALERCPCFHQGKEY
APGETVKIGCNTCVCRDRKWNCTDHVCDATCSTIGMAHYLTFDGLKYLFPGECQYVLVQDYCGSNPGTFRILV
GNKGCSHPSVKCKKRVTILVEGGEIELFDGEVNVKRPMKDETHFEVVESGRYIILLLGKALSVVWDRHLSISV
VLKQTYQEKVCGLCGNFDGIQNNDLTSSNLQVEEDPVDFGNSWKVSSQCADTRKVPLDSSPATCHNNIMKQTM
VDSSCRILTSDVFQDCNKLVDPEPYLDVCIYDTCSCESIGDCAAFCDTIAAYAHVCAQHGKVVTWRTATLCPQ
SCEERNLRENGYEAEWRYNSCAPACQVTCQHPEPLACPVQCVEGCHAHCPPGKILDELLQTCVDPEDCPVCEV
AGRRFASGKKVTLNPSDPEHCQICHCDVVNLTCEACQEPGTSESATPESGPGSEPATSGSETPGTSESATPES
GPGSEPATSGSETPGTSESATPESGPGTSTEPSEGSAPGSPAGSPTSTEEGTSESATPESGPGSEPATSGSET
PGTSESATPESGPGSPAGSPTSTEEGSPAGSPTSTEEGASSDKNTGDYYEDSYEDISAYLLSKNNAIEPRSFS
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISAKGQPREPQVYTLPPSRDELTKNQVSLT
CLVKGFYPSDIAVEWESNGQPENNYKTTPPVLDSDGSFFLYSKLTVDKSRWQQGNVFSCSVMHEALHNHYTQK
SLSLSPG Amino acid sequence of FVIII protein (312A): SEQ ID NO: 203
  1 MQIELSTCFF LCLLRFCFSA TRRYYLGAVE LSWDYMQSDL GELPVDARFP
 51 PRVPKSFPFN TSVVYKKTLF VEFTDHLFNI AKPRPPWMGL LGPTIQAEVY
101 DTVVITLKNM ASHPVSLHAV GVSYWKASEG AEYDDQTSQR EKEDDKVFPG
151 GSHTYVWQVL KENGPMASDP LCLTYSYLSH VDLVKDLNSG LIGALLVCRE
201 GSLAKEKTQT LHKFILLFAV FDEGKSWHSE TKNSLMQDRD AASARAWPKM
251 HTVNGYVNRS LPGLIGCHRK SVYWHVIGMG TTPEVHSIFL EGHTFLVRNH
301 RQASLEISPI TFLTAQTLLM DLGQFLLFCH ISSHQHDGME AYVKVDSCPE TABLE 18-continued Exemplary Chimeric Polypeptide Sequences

```
 351 EPQLRMKNNE EAEDYDDDLT DSEMDVVRFD DDNSPSFIQI RSVAKKHPKT
 401 WVHYIAAEEE DWDYAPLVLA PDDRSYKSQY LNNGPQRIGR KYKKVRFMAY
 451 TDETFKTREA IQHESGILGP LLYGEVGDTL LIIFKNQASR PYNIYPHGIT
 501 DVRPLYSRRL PKGVKHLKDF PILPGEIFKY KWTVTVEDGP TKSDPRCLTR
 551 YYSSFVNMER DLASGLIGPL LICYKESVDQ RGNQIMSDKR NVILFSVFDE
 601 NRSWYLTENI QRFLPNPAGV QLEDPEFQAS NIMHSINGYV FDSLQLSVCL
 651 HEVAYWYILS IGAQTDFLSV FFSGYTFKHK MVYEDTLTLF PFSGETVFMS
 701 MENPGLWILG CHNSDFRNRG MTALLKVSSC DKNTGDYYED SYEDISAYLL
 751 SKNNAIEPRS FSQNGTSESA TPESGPGSEP ATSGSETPGT SESATPESGP
 801 GSEPATSGSE TPGTSESATP ESGPGTSTEP SEGSAPGSPA GSPTSTEEGT
 851 SESATPESGP GSEPATSGSE TPGTSESATP ESGPGSPAGS PTSTEEGSPA
 901 GSPTSTEEGT STEPSEGSAP GTSESATPES GPGTSESATP ESGPGTSESA
 951 TPESGPGSEP ATSGSETPGS EPATSGSETP GSPAGSPTST EEGTSTEPSE
1001 GSAPGTSTEP SEGSAPGSEP ATSGSETPGT SESATPESGP GTSTEPSEGS
1051 APASSEITRT TLQSDQEEID YDDTISVEMK KEDFDIYDED ENQSPRSFQK
1101 KTRHYFIAAV ERLWDYGMSS SPHVLRNRAQ SGSVPQFKKV VFQEFTDGSF
1151 TQPLYRGELN EHLGLLGPYI RAEVEDNIMV TFRNQASRPY SFYSSLISYE
1201 EDQRQGAEPR KNFVKPNETK TYFWKVQHHM APTKDEFDCK AWAYFSDVDL
1251 EKDVHSGLIG PLLVCHTNTL NPAHGRQVTV QEFALFFTIF DETKSWYFTE
1301 NMERNCRAPC NIQMEDPTFK ENYRFHAING YIMDTLPGLV MAQDQRIRWY
1351 LLSMGSNENI HSIHFSGHVF TVRKKEEYKM ALYNLYPGVF ETVEMLPSKA
1401 GIWRVECLIG EHLHAGMSTL FLVYSNKCQT PLGMASGHIR DFQITASGQY
1451 GQWAPKLARL HYSGSINAWS TKEPFSWIKV DLLAPMIIHG IKTQGARQKF
1501 SSLYISQFII MYSLDGKKWQ TYRGNSTGTL MVFFGNVDSS GIKHNIFNPP
1551 IIARYIRLHP THYSIRSTLR MELMGCDLNS CSMPLGMESK AISDAQITAS
1601 SYFTNMFATW SPSKARLHLQ GRSNAWRPQV NNPKEWLQVD FQKTMKVTGV
1651 TTQGVKSLLT SMYVKEFLIS SSQDGHQWTL FFQNGKVKVF QGNQDSFTPV
1701 VNSLDPPLLT RYLRIHPQSW VHQIALRMEV LGCEAQDLYD KTHTCPPCPA
1751 PELLGGPSVF LFPPKPKDTL MISRTPEVTC VVVDVSHEDP EVKFNWYVDG
1801 VEVHNAKTKP REEQYNSTYR VVSVLTVLHQ DWLNGKEYKC KVSNKALPAP
1851 IEKTISKAKG QPREPQVYTL PPSRDELTKN QVSLTCLVKG FYPSDIAVEW
1901 ESNGQPENNY KTTPPVLDSD GSFFLYSKLT VDKSRWQQGN VFSCSVMHEA
1951 LHNHYTQKSL SLSPG*

Nucleotide sequence encoding FVIII 312A: SEQ ID NO: 204
   1 ATGCAAATAG AGCTCTCCAC CTGCTTCTTT CTGTGCCTTT TGCGATTCTG
  51 CTTTAGTGCC ACCAGAAGAT ACTACCTGGG TGCAGTGGAA CTGTCATGGG
 101 ACTATATGCA AAGTGATCTC GGTGAGCTGC CTGTGGACGC AAGATTTCCT
 151 CCTAGAGTGC CAAAATCTTT TCCATTCAAC ACCTCAGTCG TGTACAAAAA
 201 GACTCTGTTT GTAGAATTCA CGGATCACCT TTTCAACATC GCTAAGCCAA
 251 GGCCACCCTG GATGGGTCTG CTAGGTCCTA CCATCCAGGC TGAGGTTTAT
 301 GATACAGTGG TCATTACACT TAAGAACATG GCTTCCCATC CTGTCAGTCT
 351 TCATGCTGTT GGTGTATCCT ACTGGAAAGC TTCTGAGGGA GCTGAATATG
 401 ATGATCAGAC CAGTCAAAGG GAGAAAGAAG ATGATAAAGT CTTCCCTGGT
 451 GGAAGCCATA CATATGTCTG GCAGGTCCTG AAAGAGAATG GTCCAATGGC
 501 CTCTGACCCA CTGTGCCTTA CCTACTCATA TCTTTCTCAT GTGGACCTGG
 551 TAAAAGACTT GAATTCAGGC CTCATTGGAG CCCTACTAGT ATGTAGAGAA
 601 GGGAGTCTGG CCAAGGAAAA GACACAGACC TTGCACAAAT TTATACTACT
 651 TTTTGCTGTA TTTGATGAAG GGAAAAGTTG GCACTCAGAA ACAAAGAACT
 701 CCTTGATGCA GGATAGGGAT GCTGCATCTG CTCGGGCCTG GCCTAAAATG
 751 CACACAGTCA ATGGTTATGT AAACAGGTCT CTGCCAGGTC TGATTGGATG
 801 CCACAGGAAA TCAGTCTATT GGCATGTGAT TGGAATGGGC ACCACTCCTG
 851 AAGTGCACTC AATATTCCTC GAAGGTCACA CATTTCTTGT GAGGAACCAT
 901 CGCCAGGCGT CCTTGGAAAT CTCGCCAATA ACTTTCCTTA CTGCTAAAC
 951 ACTCTTGATG GACCTTGGAC AGTTTCTACT GTTTTGTCAT ATCTCTTCCC
1001 ACCAACATGA TGGCATGGAA GCTTATGTCA AAGTAGACAG CTGTCCAGGA
1051 GAACCCCAAC TACGAATGAA AAATAATGAA GAAGCGGAAG ACTATGATGA
1101 TGATCTTACT GATTCTGAAA TGGATGTGGT CAGGTTTGAT GATGACAACT
1151 CTCCTTCCTT TATCCAAATT CGCTCAGTTG CCAAGAAGCA TCCTAAAACT
1201 TGGGTACATT ACATTGCTGC TGAAGAGGAG GACTGGGACT ATGCTCCCTT
1251 AGTCCTCGCC CCCGATGACA GAAGTTATAA AAGTCAATAT TTGAACAATG
1301 GCCCTCAGCG GATTGGTAGG AAGTACAAAA AGTCCGATT TATGGCATAC
1351 ACAGATGAAA CCTTTAAGAC TCGTGAAGCT ATTCAGCATG AATCAGGAAT
1401 CTTGGGACCT TTACTTTATG GGGAAGTTGG AGACACACTG TTGATTATAT
1451 TTAAGAATCA AGCAAGCAGA CCATATAACA TCTACCCTCA CGGAATCACT
1501 GATGTCCGTC CTTTGTATTC AAGGAGATTA CCAAAAGGTG TAAAACATTT
1551 GAAGGATTTT CCAATTCTGC CAGGAGAAAT ATTCAAATAT AAATGGACAG
1601 TGACTGTAGA AGATGGGCCA ACTAAATCAG ATCCTCGGTG CCTGACCCGC
1651 TATTACTCTA GTTTCGTTAA TATGGAGAGA GATCTAGCTT CAGGACTCAT
1701 TGGCCCTCTC CTCATCTGCT ACAAAGAATC TGTAGATCAA AGAGGAAACC
1751 AGATAATGTC AGACAAGAGG AATGTCATCC TGTTTTCTGT ATTTGATGAG
1801 AACCGAAGCT GGTACCTCAC AGAGAATATA CAACGCTTTC TCCCCAATCC
1851 AGCTGGAGTG CAGCTTGAGG ATCCAGAGTT CCAAGCCTCC AACATCATGC
1901 ACAGCATCAA TGGCTATGTT TTTGATAGTT TGCAGTTGTC AGTTTGTTTG
1951 CATGAGGTGG CATACTGGTA CATTCTAAGC ATTGGAGCAC AGACTGACTT
2001 CCTTTCTGTC TTCTTCTCTG GATATACCTT CAAACACAAA ATGGTCTATG
2051 AAGACACACT CACCCTATTC CCATTCTCAG GAGAAACTGT CTTCATGTCC
2101 ATGGAAAACC CAGGTCTATG GATTCTGGGG TGCCACAACT CAGACTTTCG
```

TABLE 18-continued

Exemplary Chimeric Polypeptide Sequences

```
2151 GAACAGAGGC ATGACCGCCT TACTGAAGGT TTCTAGTTGT GACAAGAACA
2201 CTGGTGATTA TTACGAGGAC AGTTATGAAG ATATTTCAGC ATACTTGCTG
2251 AGTAAAAACA ATGCCATTGA ACCAAGAAGC TTCTCTCAAA ACGGTACCTC
2301 AGAGTCTGCT ACCCCCGAGT CAGGGCCAGG ATCAGAGCCA GCCACCTCCG
2351 GGTCTGAGAC ACCCGGGACT TCCGAGAGTG CCACCCCTGA GTCCGGACCC
2401 GGGTCCGAGC CCGCCACTTC CGGCTCCGAA ACTCCCGGCA CAAGCGAGAG
2451 CGCTACCCCA GAGTCAGGAC CAGGAACATC TACAGAGCCC TCTGAAGGCT
2501 CCCGCTCCAGG GTCCCCAGCC GGCAGTCCCA CTAGCACCGA GGAGGGAACC
2551 TCTGAAAGCG CCACACCCGA ATCAGGGCCA GGGTCTGAGC CTGCTACCAG
2601 CGGCAGCGAG ACACCAGGCA CCTCTGAGTC CGCCACACCA GAGTCCGGAC
2651 CCGGATCTCC CGCTGGGAGC CCCACCTCCA CTGAGGAGGG ATCTCCTGCT
2701 GGCTCTCCAA CATCTACTGA GGAAGGAACC TCAACCGAGC CATCCGAGGG
2751 ATCAGCTCCC GGCACCTCAG AGTCGGCAAC CCCGGAGTCT GGACCCGGAA
2801 CTTCCGAAAG TGCCACACCA GAGTCCGGTC CCGGGACTTC AGAATCAGCA
2851 ACACCCGAGT CCGGCCCTGG GTCTGAACCC GCCACAAGTG GTAGTGAGAC
2901 ACCAGGATCA GAACCTGCTA CCTCAGGGTC AGAGACACCC GGATCTCCGG
2951 CAGGCTCACC AACCTCCACT GAGGAGGGCA CCAGCACAGA ACCAAGCGAG
3001 GGCTCCGCAC CCGGAACAAG CACTGAACCC AGTGAGGGTT CAGCACCCGG
3051 CTCTGAGCCG GCCACAAGTG GCAGTGAGAC ACCCGGCACT TCAGAGAGTG
3101 CCACCCCCGA GAGTGGCCCA GGCACTAGTA CCGAGCCCTC TGAAGGCAGT
3151 GCGCCAGCCT CGAGCGAAAT AACTCGTACT ACTCTTCAGT CAGATCAAGA
3201 GGAAATTGAC TATGATGATA CCATATCAGT TGAAATGAAG AAGGAAGATT
3251 TTGACATTTA TGATGAGGAT GAAAATCAGA GCCCCCGCAG CTTTCAAAAG
3301 AAAACACGAC ACTATTTTAT TGCTGCAGTG GAGAGGCTCT GGGATTATGG
3351 GATGAGTAGC TCCCCACATG TTCTAAGAAA CAGGGCTCAG AGTGGCAGTG
3401 TCCCTCAGTT CAAGAAAGTT GTTTTCCAGG AATTTACTGA TGGCTCCTTT
3451 ACTCAGCCCT TATACCGTGG AGAACTAAAT GAACATTTGG GACTCCTGGG
3501 GCCATATATA AGAGCAGAAG TTGAAGATAA TATCATGGTA ACTTTCAGAA
3551 ATCAGGCCTC TCGTCCCTAT TCCTTCTATT CTAGCTTTAT TTCTTATGAG
3601 GAAGATCAGA GGCAAGGAGC AGAACCTAGA AAAAACTTTG TCAAGCCTAA
3651 TGAAACCAAA ACTTACTTTT GGAAAGTGCA ACATCATATG GCACCCACTA
3701 AAGATGAGTT TGACTGCAAA GCCTGGGCTT ATTTCTCTGA TGTTGACCTG
3751 GAAAAAGATG TGCACTCAGG CCTGATTGGA CCCCTTCTGG TCTGCCACAC
3801 TAACACACTG AACCCTGCTC ATGGGAGACA AGTGACAGTA CAGGAATTTG
3851 CTCTGTTTTT CACCATCTTT GATGAGACCA AAGCTGGTA CTTCACTGAA
3901 AATATGGAAA GAAACTGCAG GGCTCCCTGC AATATCCAGA TGGAAGATCC
3951 CACTTTTAAA GAGAATTATC GCTTCCATGC AATCAATGGC TACATAATGG
4001 ATACACTACC TGGCTTAGTA ATGGCTCAGG ATCAAAGGAT TCGATGGTAT
4051 CTGCTCAGCA TGGGCAGCAA TGAAAACATC CATTCTATTC ATTTCAGTGG
4101 ACATGTGTTC ACTGTACGAA AAAAAGAGGA GTATAAAATG GCACTGTACA
4151 ATCTCTATCC AGGTGTTTTT GAGACAGTGG AAATGTTACC ATCCAAAGCT
4201 GGAATTTGGC GGGTGGAATG CCTTATTGGC GAGCATCTAC ATGCTGGGAT
4251 GAGCACACTT TTTCTGGTGT ACAGCAATAA GTGTCAGACT CCCCTGGGAA
4301 TGGCTTCTGG ACACATTAGA GATTTTCAGA TTACAGCTTC AGGACAATAT
4351 GGACAGTGGG CCCCAAAGCT GGCCAGACTT CATTATTCCG GATCAATCAA
4401 TGCCTGGAGC ACCAAGGAGC CCTTTTCTTG GATCAAGGTG GATCTGTTGG
4451 CACCAATGAT TATTCACGGC ATCAAGACCC AGGGTGCCCG TCAGAAGTTC
4501 TCCAGCCTCT ACATCTCTCA GTTTATCATC ATGTATAGTC TTGATGGGAA
4551 GAAGTGGCAG ACTTATCGAG GAAATTCCAC TGGAACCTTA ATGGTCTTCT
4601 TTGGCAATGT GGATTCATCT GGGATAAAAC ACAATATTTT TAACCCTCCA
4651 ATTATTGCTC GATACATCCG TTTGCACCCA ACTCATTATA GCATTCGCAG
4701 CACTCTTCGC ATGGAGTTGA TGGGCTGTGA TTTAAATAGT TGCAGCATGC
4751 CATTGGGAAT GGAGAGTAAA GCAATATCAG ATGCACAGAT TACTGCTTCA
4801 TCCTACTTTA CCAATATGTT TGCCACCTGG TCTCCTTCAA AAGCTCGACT
4851 TCACCTCCAA GGGAGGAGTA ATGCCTGGAG ACCTCAGGTG AATAATCCAA
4901 AAGAGTGGCT GCAAGTGGAC TTCCAGAAGA CAATGAAAGT CACAGGAGTA
4951 ACTACTCAGG GAGTAAAATC TCTGCTTACC AGCATGTATG TGAAGGAGTT
5001 CCTCATCTCC AGCAGTCAAG ATGGCCATCA GTGGACTCTC TTTTTTCAGA
5051 ATGGCAAAGT AAAGGTTTTT CAGGGAAATC AAGACTCCTT CACACCTGTG
5101 GTGAACTCTC TAGACCCACC GTTACTGACT CGCTACCTTC GAATTCACCC
5151 CCAGAGTTGG GTGCACCAGA TTGCCCTGAG GATGGAGGTT CTGGGCTGCG
5201 AGGCACAGGA CCTCTACGAC AAAACTCACA CATGCCCACC GTGCCCAGCT
5251 CCAGAACTCC TGGGCGGACC GTCAGTCTTC CTCTTCCCCC CAAAACCCAA
5301 GGACACCCTC ATGATCTCCC GGACCCCTGA GGTCACATGC GTGGTGGTGG
5351 ACGTGAGCCA CGAAGACCCT GAGGTCAAGT TCAACTGGTA TGTGGACGGC
5401 GTGGAAGTGC ATAATGCCAA GACAAAGCCG CGGGAGGAGC AGTACAACAG
5451 CACGTACCGT GTGGTCAGCG TCCTCACCGT CCTGCACCAA GACTGGCTGA
5501 ATGGCAAGGA GTACAAGTGC AAGGTCTCCA ACAAAGCCCT CCCAGCCCCC
5551 ATCGAGAAAA CCATCTCCAA AGCCAAAGGG CAGCCCCGAG AACCACAGGT
5601 GTACACCCTG CCCCCATCCC GGGATGAGCT GACCAAGAAC CAAGTTAGCC
5651 TGACCTGCCT GGTCAAAGGC TTCTATCCCA GCGACATCGC CGTGGAGTGG
5701 GAGAGCAATG GGCAGCCGGA GAACAACTAC AAGACCACGC CTCCCGTGTT
5751 GGACTCCGAC GGCTCCTTCT TCCTCTACTC CAAGCTCACC GTGGACAAGA
5801 GCAGGTGGCA GCAGGGGAAC GTCTTCTCAT GCTCCGTGAT GCATGAGGCT
5851 CTGCACAACC ACTACACGCA GAAGAGCCTC TCCCTGTCTC CGGGTTGA
```

TABLE 18-continued

Exemplary Chimeric Polypeptide Sequences

Amino acid sequence of VWF059A protein: SEQ ID NO: 205
```
   1 MIPARFAGVL LALALILPGT LCAEGTRGRS STARCSLFGS DEVNTEDGSM
  51 YSFAGYCSYL LAGGCQKRSF SIIGDFQNGK RVSLSVYLGE FFDIHLFVNG
 101 TVTQGDQRVS MPYASKGLYL ETEAGYYKLS GEAYGFVARI DGSGNFQVLL
 151 SDRYFNKTCG LCGNFNIFAE DDFMTQEGTL TSDPYDFANS WALSSGEQWC
 201 ERASPPSSSC NISSGEMQKG LWEQCQLLKS TSVFARCHPL VDPEPFVALC
 251 EKTLCECAGG LECACPALLE YARTCAQEGM VLYGWTDHSA CSPVCPAGME
 301 YRQCVSPCAR TCQSLHINEM CQERCVDGCS CPEGQLLDEG LCVESTECPC
 351 VHSGKRYPPG TSLSRDCNTC ICRNSQWICS NEECPGECLV TGQSHFKSFD
 401 NRYFTFSGIC QYLLARDCQD HSFSIVIETV QCADDRDAVC TRSVTVRLPG
 451 LHNSLVKLKH GAGVAMDGQD IQLPLLKGDL RIQHTVTASV RLSYGEDLQM
 501 DWDGRGRLLV KLSPVYAGKT CGLCGNYNGN QGDDFLTPSG LAEPRVEDFG
 551 NAWKLHGDCQ DLQKQHSDPC ALNPRMTRFS EEACAVLTSP TFEACHRAVS
 601 PLPYLRNCRY DVCSCSDGRE CLCGALASYA AACAGRGVRV AWREPGRCEL
 651 NCPKGQVYLQ CGTPCNLTCR SLSYPDEECN EACLEGCFCP PGLYMDERGD
 701 CVPKAQCPCY YDGEIFQPED IFSDHHTMCY CEDGFMHCTM SGVPGSLLPD
 751 AVLSSPLSHR SKRSLSCRPP MVKLVCPADN LRAEGLECTK TCQNYDLECM
 801 SMGCVSGCLC PPGMVRHENR CVALERCPCF HQGKEYAPGE TVKIGCNTCV
 851 CRDRKWNCTD HVCDATCSTI GMAHYLTFDG LKYLFPGECQ YVLVQDYCGS
 901 NPGTFRILVG NKGCSHPSVK CKKRVTILVE GGEIELFDGE VNVKRPMKDE
 951 THFEVVESGR YIILLLGKAL SVVWDRHLSI SVVLKQTYQE KVCGLCGNFD
1001 GIQNNDLTSS NLQVEEDPVD FGNSWKVSSQ CADTRKVPLD SSPATCHNNI
1051 MKQTMVDSSC RILTSDVFQD CNKLVDPEPY LDVCIYDTCS CESIGDCAAF
1101 CDTIAAYAHV CAQHGKVVTW RTATLCPQSC EERNLRENGY EAEWRYNSCA
1151 PACQVTCQHP EPLACPVQCV EGCHAHCPPG KILDELLQTC VDPEDCPVCE
1201 VAGRRFASGK KVTLNPSDPE HCQICHCDVV NLTCEACQEP GTSESATPES
1251 GPGSEPATSG SETPGTSESA TPESGPGSEP ATSGSETPGT SESATPESGP
1301 GTSTEPSEGS APGSPAGSPT STEEGTSESA TPESGPGSEP ATSGSETPGT
1351 SESATPESGP GSPAGSPTST EEGSPAGSPT STEEGASSDK NTGDYYEDSY
1401 EDISAYLLSK NNAIEPRSFS DKTHTCPPCP APELLGGPSV FLFPPKPKDT
1451 LMISRTPEVT CVVVDVSHED PEVKFNWYVD GVEVHNAKTK PREEQYNSTY
1501 RVVSVLTVLH QDWLNGKEYK CKVSNKALPA PIEKTISKAK GQPREPQVYT
1551 LPPSRDELTK NQVSLTCLVK GFYPSDIAVE WESNGQPENN YKTTPPVLDS
1601 DGSFFLYSKL TVDKSRWQQG NVFSCSVMHE ALHNHYTQKS LSLSPG*
```

Nucleotide sequence encoding VWF059A protein: SEQ ID NO: 206
```
   1 ATGATTCCTG CCAGATTTGC CGGGGTGCTG CTTGCTCTGG CCCTCATTTT
  51 GCCAGGGACC CTTTGTGCAG AAGGAACTCG CGGCAGGTCA TCCACGGCCC
 101 GATGCAGCCT TTTCGGAAGT GACTTCGTCA ACACCTTTGA TGGGAGCATG
 151 TACAGCTTTG CGGGATACTG CAGTTACCTC CTGGCAGGGG GCTGCCAGAA
 201 ACGCTCCTTC TCGATTATTG GGGACTTCCA GAATGGCAAG AGAGTGAGCC
 251 TCTCCGTGTA TCTTGGGGAA TTTTTTGACA TCCATTTGTT TGTCAATGGT
 301 ACCGTGACAC AGGGGGACCA AAGAGTCTCC ATGCCCTATG CCTCCAAGGG
 351 GCTGTATCTA GAAACTGAGG CTGGGTACTA CAAGCTGTCC GGTGAGGCCT
 401 ATGGCTTTGT GGCCAGGATC GATGGCAGCG GCAACTTTCA AGTCCTGCTG
 451 TCAGACAGAT ACTTCAACAA GACCTGCGGG CTGTGTGGCA ACTTTAACAT
 501 CTTTGCTGAA GATGACTTTA TGACCCAAGA AGGGACCTTG ACCTCGGACC
 551 CTTATGACTT TGCCAACTCA TGGGCTCTGA GCAGTGGAGA ACAGTGGTGT
 601 GAACGGGCAT CTCCTCCCAG CAGCTCATGC AACATCTCCT CTGGGGAAAT
 651 GCAGAAGGGC CTGTGGGAGC AGTGCCAGCT TCTGAAGAGC ACCTCGGTGT
 701 TTGCCCGCTG CCACCCTCTG GTGGACCCCG AGCCTTTTGT GGCCCTGTGT
 751 GAGAAGACTT TGTGTGAGTG TGCTGGGGGG CTGGAGTGCG CCTGCCCTGC
 801 CCTCCTGGAG TACGCCCCGGA CCTGTGCCCA GGAGGGAATG GTGCTGTACG
 851 GCTGGACCGA CCACAGCGCG TGCAGCCCAG TGTGCCCTGC TGGTATGGAG
 901 TATAGGCAGT GTGTGTCCCC TTGCGCCAGG ACCTGCCAGA GCCTGCACAT
 951 CAATGAAATG TGTCAGGAGC GATGCGTGGA TGGCTGCAGC TGCCCTGAGG
1001 GACAGCTCCT GGATGAAGGC CTCTGCGTGG AGAGCACCGA GTGTCCCTGC
1051 GTGCATTCCG GAAAGCGCTA CCCTCCCGGC ACCTCCCTCT CTCGAGACTG
1101 CAACACCTGC ATTTGCCGAA ACAGCCAGTG GATCTGCAGC AATGAAGAAT
1151 GTCCAGGGGA GTGCCTTGTC ACTGGTCAAT CCCACTTCAA GAGCTTTGAC
1201 AACAGATACT TCACCTTCAG TGGGATCTGC CAGTACCTGC TGGCCCGGGA
1251 TTGCCAGGAC CACTCCTTCT CCATTGTCAT TGAGACTGTC CAGTGTGCTG
1301 ATGACCGCGA CGCTGTGTGC ACCCGCTCCG TCACCGTCCG GCTGCCTGGC
1351 CTGCACAACA GCCTTGTGAA ACTGAAGCAT GGGGCAGGAG TTGCCATGGA
1401 TGGCCAGGAC ATCCAGCTCC CCTCCTGAA AGGTGACCTC CGCATCCAGC
1451 ATACAGTGAC GGCCTCCGTG CGCCTCAGCT ACGGGGAGGA CCTGCAGATG
1501 GACTGGGATG GCCGCGGGAG GCTGCTGGTG AAGCTGTCCC CCGTCTATGC
1551 CGGGAAGACC TGCGGCCTGT GTGGGAATTA CAATGGCAAC AGGGCGCACG
1601 ACTTCCTTAC CCCCTCTGGG CTGGCGGAGC CCCGGGTGGA GGACTTCGGG
1651 AACGCCTGGA AGCTGCACGG GGACTGCCAG GACCTGCAGA AGCAGCACAG
1701 CGATCCCTGC GCCCTCAACC CGCGCATGAC CAGGTTCTCC GAGGAGGCGT
1751 GCGCGGTCCT GACGTCCCCC ACATTCGAGG CCTGCCATCG TGCCGTCAGC
1801 CCGCTGCCCT ACCTGCGGAA CTGCCGCTAC GACGTGTGCT CCTGCTCGGA
1851 CGGCCGCGAG TGCCTGTGCG GCGCCCTGGC CAGCTATGCC GCGGCCTGCG
1901 CGGGGAGAGG CGTGCGCGTC GCGTGGCGCG AGCCAGGCCG CTGTGAGCTG
1951 AACTGCCCGA AAGGCCAGGT GTACCTGCAG TGCGGGACCC CCTGCAACCT
2001 GACCTGCCGC TCTCTCTCTT ACCCGGATGA GGAATGCAAT GAGGCCTGCC
```

TABLE 18-continued

Exemplary Chimeric Polypeptide Sequences

```
2051 TGGAGGGCTG CTTCTGCCCC CCAGGGCTCT ACATGGATGA GAGGGGGGAC
2101 TGCGTGCCCA AGGCCCAGTG CCCCTGTTAC TATGACGGTG AGATCTTCCA
2151 GCCAGAAGAC ATCTTCTCAG ACCATCACAC CATGTGCTAC TGTGAGGATG
2201 GCTTCATGCA CTGTACCATG AGTGGAGTCC CCGGAAGCTT GCTGCCTGAC
2251 GCTGTCCTCA GCAGTCCCCT GTCTCATCGC AGCAAAAGGA GCCTATCCTG
2301 TCGGCCCCCC ATGGTCAAGC TGGTGTGTCC CGCTGACAAC CTGCGGGCTG
2351 AAGGGCTCGA GTGTACCAAA ACGTGCCAGA ACTATGACCT GGAGTGCATG
2401 AGCATGGGCT GTGTCTCTGG CTGCCTCTGC CCCCCGGGCA TGGTCCGGCA
2451 TGAGAACAGA TGTGTGGCCC TGGAAAGGTG TCCCTGCTTC CATCAGGGCA
2501 AGGAGTATGC CCCTGGAGAA ACAGTGAAGA TTGGCTGCAA CACTTGTGTC
2551 TGTCGGGACC GGAAGTGGAA CTGCACAGAC CATGTGTGTG ATGCCACGTG
2601 CTCCACGATC GGCATGGCCC ACTACCTCAC CTTCGACGGG CTCAAATACC
2651 TGTTCCCCGG GGAGTGCCAG TACGTTCTGG TGCAGGATTA CTGCGGCAGT
2701 AACCCTGGGA CCTTTCGGAT CCTAGTGGGG AATAAGGGAT GCAGCCACCC
2751 CTCAGTGAAA TGCAAGAAAC GGGTCACCAT CCTGGTGGAG GGAGGAGAGA
2801 TTGAGCTGTT TGACGGGGAG GTGAATGTGA AGAGGCCCAT GAAGGATGAG
2851 ACTCACTTTG AGGTGGTGGA GTCTGGCCGG TACATCATTC TGCTGCTGGG
2901 CAAAGCCCTC TCCGTGGTCT GGGACCGCCA CCTGAGCATC TCCGTGGTCC
2951 TGAAGCAGAC ATACCAGGAG AAAGTGTGTG GCCTGTGTGG GAATTTTGAT
3001 GGCATCCAGA ACAATGACCT CACCAGCAGC AACCTCCAAG TGGAGGAAGA
3051 CCCTGTGGAC TTTGGGAACT CCTGGAAAGT GAGCTCGCAG TGTGCTGACA
3101 CCAGAAAAGT GCCTCTGGAC TCATCCCCTG CCACCTGCCA TAACAACATC
3151 ATGAAGCAGA CGATGGTGGA TTCCTCCTGT AGAATCCTTA CCAGTGACGT
3201 CTTCCAGGAC TGCAACAAGC TGGTGGACCC CGAGCCATAT CTGGATGTCT
3251 GCATTTACGA CACCTGCTCC TGTGAGTCCA TTGGGGACTG CGCCGCATTC
3301 TGCGACACCA TTGCTGCCTA TGCCCACGTG TGTGCCCAGC ATGGCAAGGT
3351 GGTGACCTGG AGGACGGCCA CATTGTGCCC CCAGAGCTGC GAGGAGAGGA
3401 ATCTCCGGGA GAACGGGTAT GAGGCTGAGT GGCGCTATAA CAGCTGTGCA
3451 CCTGCCTGTC AAGTCACGTG TCAGCACCCT GAGCCACTGG CCTGCCCTGT
3501 GCAGTGTGTG GAGGGCTGCC ATGCCCACTG CCCTCCAGGG AAAATCCTGG
3551 ATGAGCTTTT GCAGACCTGC GTTGACCCTG AAGACTGTCC AGTGTGTGAG
3601 GTGGCTGGCC GGCGTTTTGC CTCAGGAAAG AAAGTCACCT TGAATCCCAG
3651 TGACCCTGAG CACTGCCAGA TTTGCCACTG TGATGTTGTC AACCTCACCT
3701 GTGAAGCCTG CCAGGAGCCG GGTACATCAG AGAGCGCCAC CCCTGAAAGT
3751 GGTCCCGGGA GCGAGCCAGC CACATCTGGG TCGGAAACGC CAGGCACATC
3801 CGAGTCTGCA ACTCCCGAGT CCGGACCTGG CTCCGAGCCT GCCACTAGCG
3851 GCTCCGAGAC TCCGGGAACT TCCGAGAGCG CTACACCAGA AAGCGGACCC
3901 GGAACCAGTA CCGAACCTAG CGAGGGCTCT GCTCCGGGCA GCCCAGCCGG
3951 CTCTCCTACA TCCACGGAGG AGGGCACTTC CGAATCCGCC ACCCCGGAGT
4001 CAGGGCCAGG ATCTGAACCC GCTACCTCAG GCAGTGAGAC GCCAGGAACG
4051 AGCGAGTCCG CTACACCGGA GAGTGGGCCA GGGAGCCCTG CTGGATCTCC
4101 TACGTCCACT GAGGAAGGGT CACCAGCGGG CTCGCCCACC AGCACTGAAG
4151 AAGGTGCCTC GTCTGACAAG AACACTGGTG ATTATTACGA GGACAGTTAT
4201 GAAGATATTT CAGCATACTT GCTGAGTAAA AACAATGCCA TTGAACCAAG
4251 AAGCTTCTCT GACAAAACTC ACACATGCCC ACCGTGCCCA GCTCCAGAAC
4301 TCCTGGGCGG ACCGTCAGTC TTCCTCTTCC CCCCAAAACC CAAGGACACC
4351 CTCATGATCT CCCGGACCCC TGAGGTCACA TGCGTGGTGG TGGACGTGAG
4401 CCACGAAGAC CCTGAGGTCA AGTTCAACTG GTATGTGGAC GGCGTGGAAG
4451 TGCATAATGC CAAGACAAAG CCGCGGGAGG AGCAGTACAA CAGCACGTAC
4501 CGTGTGGTCA GCGTCCTCAC CGTCCTGCAC CAAGACTGGC TGAATGGCAA
4551 GGAGTACAAG TGCAAGGTCT CCAACAAAGC CCTCCCAGCC CCCATCGAGA
4601 AAACCATCTC CAAAGCCAAA GGGCAGCCCC GAGAACCACA GGTGTACACC
4651 CTGCCCCCAT CCCGGGATGA GCTGACCAAG AACCAAGTTA GCCTGACCTG
4701 CCTGGTCAAA GGCTTCTATC CCAGCGACAT CGCCGTGGAG TGGGAGAGCA
4751 ATGGGCAGCC GGAGAACAAC TACAAGACCA CGCCTCCCGT GTTGGACTCC
4801 GACGGCTCCT TCTTCCTCTA CTCCAAGCTC ACCGTGGACA AGAGCAGGTG
4851 GCAGCAGGGG AACGTCTTCT CATGCTCCGT GATGCATGAG GCTCTGCACA
4901 ACCACTACAC GCAGAAGAGC CTCTCCCTGT CTCCGGGTTG A
```

A-FVIII(XTEN)-Fc: SEQ ID NO: 207
ATRRYYLGAVELSWDYMQSDLGELPVDARFPPRVPKSFPFNTSVVYKKTLFVEFTDHLFNIAKPRPPWMGLLG
PTIQAEVYDTVVITLKNMASHPVSLHAVGVSYWKASEGAEYDDQTSQREKEDDKTVFPGGSHTYVWQVLKENG
PMASDPLCLTYSYLSHVDLVKDLNSGLIGALLVCREGSLAKEKDTQTLHKFILLFAVFDEGKSWHSETKNSLMQ
DRDAASARAWPKMHTVNGYVNRSLPGLIGCHRKSVYWHVIGMGTTPEVHSIFLEGHTFLVRNHRQASLEISPI
TFLTAQTLLMDLGQGLLGCHISSHQHDGMEAYVKVDSCPEEPQLRMKNNEEAEDYDDDLTDSEMDVVRFDDDN
SPSFIQIRSVAKKHPKTWVHYIAAEEEDWDYAPLVLAPDDRSYKSQYLNNGPQRIGRKYKKVRFMAYTDETFK
TREAIQHESGILGPLLYGEVGDTLLIIFKNQASRPYNIYPHGITDVRPLYSRRLPKGVKHLKDFPILPGEIFK
YKWTVTVEDGPTKSDPRCLTRYYSSFVNMERDLASGLIGPLLICYKESVDQRGNQIMSDKRNVILFSVFDENR
SWYLTENIQRFLPNPAGVQLEDPEFQASNIMHSINGYVFDSLQLSVCLHEVAYWYILSIGAQTDFLSVFFSGY
TFKHKMVYEDTLTLFPFSGETVFMSMENPGLWILGCHNSDFRNRGMTALLKVSSCDKNTGDYYEDSYEDISAY
LLSKNNAIEPRSFSQNGTSESATPESGPGSEPATSGSETPGTSESATPESGPGSEPATSGSETPGTSESATPE
SGPGTSTEPSEGSAPGSPAGSPTSTEEGTSESATPESGPGSEPATSGSETPGTSESATPESGPGSPAGSPTST
EEGSPAGSPTSTEEGTSTEPSEGSAPGTSESATPESGPGSEPATSGSETPGTSESATPESGPGSEPATSGSET
PGSEPATSGSETPGSPAGSPTSTEEGTSTEPSEGSAPGTSTEPSEGSAPGSEPATSGSETPGTSESATPESGP
GTSTEPSEGSAPASSEITRTTLQSDQEEIDYDDTISVEMKKEDFDIYDEDENQSPRSFQKKTRHYFIAAVELW
DYGMSSSPHVLRNRAQSGSVPQFKKVVFQEFTDGSFTQPLYRGELNEHLGLLGPYIRAEVEDNIMVTFRNQAS
RPYSFYSSLISYEEDQRQGAEPRKNFVKPNETKTYFWKVQHHMAPTKDEFDCKAWAYFSDVDLEKDVHSGLIG
PLLVCHTNTLNPAHGRQVTVQEFALFFTIFDETKSWYFTENMERNCRAPCNIQMEDPTFKENYRFHAINGYIM

TABLE 18-continued

Exemplary Chimeric Polypeptide Sequences

```
DTLPGLVMAQDQRIRWYLLSMGSNENIHSIHFSGHVFTVRKKEEYKMALYNLYPGVEFTVEMLPSKAGIWRVE
CLIGHELHAGMSTLFLVYSNKCQTPLGMASGHIRDFQITASGQYGQWAPKLARLHYSGSINAWSTKEPFSWIK
VDLLAPMIIHGIKTQGARQKFSSLYISQFIIMYSLDGKKWQTYRGNSTGTLMVFFGNVDSSGIKHNIFNPPII
ARYIRLHPTHYSIRSTLRMELMGCDLNSCSMPLGMESKAISDAQITASSYFTNMFATWSPSKARLHLQGRSNA
WRPQVNNPKEWLQVDFQKTMKVTGVTTQGVKSLLTSMYVKEFLISSSQDGHQWTLFFQNQKVKVFQGNQDSFT
PVVNSLDPPLLTRYLRIHPQSWVHQIALRMEVLGCEAQDLYDKTHTCPPCPAPELLGGPSVFLFPPKPKDTLM
ISRTPEVTCVVVDVSHEDPEVKFNWYVDGVEVHNAKTKPREEQYNSTRYVVSVLTVLHQDWLNGKEYKCKVSN
KALPAPIEKTISKAKGQPREPQVYTLPPSRDELTKNQVSLTCLVKGFYPSDIAVEWESNGQPENNYTKTTPPV
LDSDGSFFLYSKLTVDKSRWQQGNVFSVSVMHEALHNHYTQKSLSLSPG
```

TABLE 19

Additional chimeric polypeptide sequences

| Description/<br>SEQ ID NO. | Sequence | |
|---|---|---|
| AE288<br>SEQ ID NO: 8 | GTSESATPES GPGSEPATSG SETPGTSESA TPESGPGSEP ATSGSETPGT SESATPESGP | 60 |
| | GTSTEPSEGS APGSPAGSPT STEEGTSESA TPESGPGSEP ATSGSETPGT SESATPESGP | 120 |
| | GSPAGSPTST EEGSPAGSPT STEEGTSTEP SEGSAPGTSE SATPESGPGT SESATPESGP | 180 |
| | GTSESATPES GPGSEPATSG SETPGSEPAT SGSETPGSPA GSPTSTEEGT STEPSEGSAP | 240 |
| | GTSTEPSEGS APGSEPATSG SETPGTSESA TPESGPGTST EPSEGSAP | 288 |
| pSYN VWF059<br>SEQ ID NO: 13 | TSTEEGASIS DKNTGDYYED SYEDISAYLL SKNNAIEPRS FSDKTH | |
| pSYN VWF059A<br>SEQ ID NO: 22 | TSTEEGASSD KNTGDYYEDS YEDISAYLLS KNNAIEPRSF SDKTH | |
| pSYN FVIII 312<br>SEQ ID NO: 173 | ATRRYYLGAV ELSWDYMQSD LGELPVDARF PPRVPKSFPF NTSVVYKKTL FVEFTDHLFN | 60 |
| | IAKPRPPWMG LLGPTIQAEV YDTVVITLKN MASHPVSLHA VGVSYWKASE GAEYDDQTSQ | 120 |
| | REKEDDKVFP GGSHTYVWQV LKENGPMASD PLCLTYSYLS HVDLVKDLNS GLIGALLVCR | 180 |
| | EGSLAKEKTQ TLHKFILLFA VFDEGKSWHS ETKNSLMQDR DAASARAWPK MHTVNGYVNR | 240 |
| | SLPGLIGCHR KSVYWHVIGM GTTPEVHSIF LEGHTFLVRN HRQASLEISP ITFLTAQTLL | 300 |
| | MDLGQFLLFC HISSHQHDGM EAYVKVDSCP EEPQLRMKNN EEAEDYDDDL TDSEMDVVRF | 360 |
| | DDDNSPSFIQ IRSVAKKHPK TWVHYIAAEE EDWDYAPLVL APDDRSYKSQ YLNNGPQRIG | 420 |
| | RKYKKVRFMA YTDETFKTRE AIQHESGILG PLLYGEVGDT LLIIFKNQAS RPYNIYPHGI | 480 |
| | TDVRPLYSRR LPKGVKHLKD FPILPGEIFK YKWTVTVEDG PTKSDPRCLT RYYSSFVNME | 540 |
| | RDLASGLIGP LLICYKESVD QRGNQIMSDK RNVILFSVFD ENRSWYLTEN IQRFLPNPAG | 600 |
| | VQLEDPEFQA SNIMHSINGY VFDSLQLSVC LHEVAYWYIL SIGAQTDFLS VFFSGYTFKH | 660 |
| | KMVYEDTLTL FPFSGETVFM SMENPGLWIL GCHNSDFRNR GMTALLKVSS CDKNTGDYYE | 720 |
| | DSYEDISAYL LSKNNAIEPR SFSQNGTSES ATPESGPGSE PATSGSETPG TSESATPESG | 780 |
| | PGSEPATSGS ETPGTSESAT PESGPGTSTE PSEGSAPGSP AGSPTSTEEG TSESATPESG | 840 |
| | PGSEPATSGS ETPGTSESAT PESGPGSPAG SPTSTEEGSP AGSPTSTEEG TSTEPSEGSA | 900 |
| | PGTSESATPE SGPGTSESAT PESGPGTSES ATPESGPGSE PATSGSETPG SEPATSGSET | 960 |
| | PGSPAGSPTS TEEGTSTEPS EGSAPGTSES PSEGSAPGSE PATSGSETPG TSESATPESG | 1020 |
| | PGTSTEPSEG SAPASSEITR TTLQSDQEEI DYDDTISVEM KKEDFDIYDE DENQSPRSFQ | 1080 |
| | KKTRHYFIAA VERLWDYGMS SSPHVLRNRA QSGSVPQFKK VVFQEFTDGS FTQPLYRGEL | 1140 |
| | NEHLGLLGPY IRAEVEDNIM VTFRNQASRP YSFYSSLISY EEDQRQGAEP RKNFVKPNET | 1200 |
| | KTYFWKVQHH MAPTKDEFDS KAWAYFSDVD LEKDVHSGLI GPLLVCHTNT LNPAHGRQVT | 1260 |
| | VQEFALFFTI FDETKSWYFT ENMERNCRAP CNIQMEDPTF KENYRFHAIN GYIMDTLPGL | 1320 |
| | VMAQDQRIRW YLLSMGSNEN IHSIHFSGHV FTVRKKEEYK MALYNLYPGV FETVEMLPSK | 1380 |
| | AGIWRVECLI GEHLHAGMST LFLVYSNKCQ TPLGMASGHI RDFQITASGQ YGQWAPKLAR | 1440 |
| | LHYSGSINAW STKEPFSWIK VDLLAPMIIH GIKTQGARQK FSSLYISQFI IMYSLDGKKW | 1500 |
| | QTYRGNSTGT LMVFFGNVDS SGIKHNIFNP PIIARYIRLH PTHYSIRSTL REMLMGCDLN | 1560 |
| | SCSMPLGMES KAISDAQITA SSYFTNMFAT WSPSKARLHL QGRSNAWRPQ VNNPKEWLQV | 1620 |
| | DFQKTMKVTG VTTQGVKSLL TSMYVKEFLI SSSQDGHQWT LFFQNGKVKV FQGNQDSFTP | 1680 |
| | VVNSLDPPLL TRYLRIHPQS WVHQIALRME VLGCEAQDLY DKTHTCPPCP APELLGGPSV | 1740 |
| | FLFPPKPKDT LMISRTPEVT CVVVDVSHED PEVKFNWYVD GVEVHNAKTK PREEQYNSTY | 1800 |
| | RVVSVLTVLH QDWLNGKEYK CKVSNKALPA PIEKTISKAK GQPREPQVYT LPPSRDELTK | 1860 |
| | NQVSLTCLVK GFYPSDIAVE WESNGQPENN YKTTPPVLDS DGSFFLYSKL TVDKSRWQQG | 1920 |
| | NVFSCSVMHE ALHNHYTQKS LSLSPGK | |
| XTEN_AE288_2<br>SEQ ID NO: 54 | GSPAGSPTST EEGTSESATP ESGPGSEPAT SGSETPGTSE SATPESGPGT STEPSEGSAP | 60 |
| | GTSTEPSEGS APGSTEPSE GSAPGTSTEP SEGSAPGTST EPSEGSAPGT STEPSEGSAP | 120 |
| | GSPAGSPTST EEGTSTEPSE GSAPGTSESA TPESGPGSEP ATSGSETPGT SESATPESGP | 180 |
| | GSEPATSGSE TPGTSESATP ESGPGTSTEP SEGSAPGTSE SATPESGPGS PAGSPTSTEE | 240 |
| | GSPAGSPTST EEGSPAGSPT STEEGTSESA TPESGPGTST EPSEGSAP | 288 |
| XTEN AE144_5A<br>SEQ ID NO: 58 | TSESATPESG PGSEPATSGS ETPGTSESAT PESGPGSEPA TSGSETPGTS ESATPESGPG | 60 |
| | TSTEPSEGSA PGSPAGSPTS TEEGTSESAT PESGPGSEPA TSGSETPGTS ESATPESGPG | 120 |
| | SPAGSPTSTE EGSPAGSPTS TEEG | |

TABLE 19-continued

Additional chimeric polypeptide sequences

| Description/<br>SEQ ID NO. | Sequence | |
|---|---|---|
| a2 Linker of chimeric polypeptide SEQ ID NO: 88 | DKNTGDYYED SYEDISAYLL SKN-<br>NAIEPRS FS | 32 |
| Signal Peptide of FVIII SEQ ID NO: 64 | MQIELSTCFFLCLLRFCFS | |
| FVIII fragment 1 of chimeric polypeptide SEQ ID NO: 215 | ATRRYYLGAV ELSWDYMQSD LGELPVDARF PPRVPKSFPF NTSVVYKKTL FVEFTDHLFN | 60 |
| | IAKPRPPWMG LLGPTIQAEV YDTVVITLKN MASHPVSLHA VGVSYWKASE GAEYDDQTSQ | 120 |
| | REKEDDKVFP GGSHTYVWQV LKENGPMASD PLCLTYSYLS HVDLVKDLNS GLIGALLVCR | 180 |
| | EGSLAKEKTQ TLHKFILLFA VFDEGKSWHS ETKNSLMQDR DAASARAWPK MHTVNGYVNR | 240 |
| | SLPGLIGCHR KSVYWHVIGM GTTPEVHSIF LEGHTFLVRN HRQASLEISP ITFLTAQTLL | 300 |
| | MDLGQFLLFC HISSHQHDGM EAYVKVDSCP EEPQLRMKNN EEAEDYDDDL TDSEMDVVRF | 360 |
| | DDDNSPSFIQ IRSVAKKHPK TWVHYIAAEE EDWDYAPLVL APDDRSYKSQ YLNNGPQRIG | 420 |
| | RKYKKVRFMA YTDETFKTRE AIQHESGILG PLLYGEVGDT LLIIFKNQAS RPYNIYPHGI | 480 |
| | TDVRPLYSRR LPKGVKHLKD FPILPGEIFK YKWTVTVEDG PTKSDPRCLT RYYSSFVNME | 540 |
| | RDLASGLIGP LLICYKESVD QRGNQIMSDK RNVILFSVFD ENRSWYLTEN IQRFLPNPAG | 600 |
| | VQLEDPEFQA SNIMHSINGY VFDSLQLSVC LHEVAYWYIL SIGAQTDFLS VFFSGYTFKH | 660 |
| | KMVYEDTLTL FPFSGETVFM SMENPGLWIL GCHNSDFRNR GMTALLKVSS CDKNTGDYYE | 720 |
| | DSYEDISAYL LSKNNAIEPR SFSQN | |
| FVIII fragment 2 of chimeric polypeptide SEQ ID NO: 216 | EITRTTLQSD QEEIDYDDTI SVEMKKEDFD IYDEDENQSP RSFQKKTRHY FIAAVERLWD | 60 |
| | YGMSSSPHVL RNRAQSGSVP QFKKVVFQEF TDGSFTQPLY RGELNEHLGL LGPYIRAEVE | 120 |
| | DNIMVTFRNQ ASRPYSFYSS LISYEEDQRQ GAEPRKNFVK PNETKTYFWK VQHHMAPTKD | 180 |
| | EFDCKAWAYF SDVDLEKDVH SGLIGPLLVC HTNTLNPAHG RQVTVQEFAL FFTIFDETKS | 240 |
| | WYFTENMERN CRAPCNIQME DPTFKENYRF HAINGYIMDT LPGLVMAQDQ RIRWYLLSMG | 300 |
| | SNENIHSIHF SGHVFTVRKK EETKMALYNL YPGVFETVEM LPSKAGIWRV ECLIGEHLHA | 360 |
| | GMSTLFLVYS NKCQTPLGMA SGHIRDFQIT ASGQYGQWAP KLARLHYSGS INAWSTKEPF | 420 |
| | SWIKVDLLAP MIIHGIKTQG ARQKFSSLYI SQFIIMYSLD GKKWQTYRGN STGTLMVFFG | 480 |
| | NVDSSGIKHN IFNPPIIARY IRLHPTHYSI RSTLRMELMG CDLNSCSMPL GMESKAISDA | 540 |
| | QITASSYFTN MFATWSPSKA RLHLQGRSNA WRPQVNNPKE WLQVDFQKTM KVTGVTTQGV | 600 |
| | KSLLTSMYVK EFLISSSQDG HQWTLFFQNG KVKVFQGNQD SFTPVVNSLD PPLLTRYLRI | 660 |
| | HPQSWVHQIA LRMEVLGCEA QDLY | |
| VWF Signal Peptide SEQ ID NO: 208 | MIPARFAGVL LALALILPGT LC | |
| VWF D1D2 domain of chimeric polypeptide SEQ ID NO: 209 | AEGTRGRSST ARCSLFGSDF VNTFDGSMYS FAGYCSYLLA GGCQKRSFSI IGDFQNGKRV | 60 |
| | SLSVYLGEFF DIHLFVNGTV TQGDQRVSMP YASKGLYLET EAGYYKLSGE AYGFVARIDG | 120 |
| | SGNFQVLLSD RYFNKTCGLC GNFNIFAEDD FMTQEGTLTS DPYDFANSWA LSSGEQWCER | 180 |
| | ASPPSSSCNI SSGEMQKGLW EQCQLLKSTS VFARCHPLVD PEPFVALCEK TLCECAGGLE | 240 |
| | CACPALLEYA RTCAQEGMVL YGWTDHSACS PVCPAGMEYR QCVSPCARTC QSLHINEMCQ | 300 |
| | ERCVDGCSCP EGQLLDEGLC VESTECPCVH SGKRYPPGTS LSRDCNTCIC RNSQWICSNE | 360 |
| | ECPGECLVTG QSHFKSFDNR YFTFSGICQY LLARDCQDHS FSIVIETVQC ADDRDAVCTR | 420 |
| | SVTVRLPGLH NSLVKLKHGA GVAMDGQDIQ LPLLKGDLRI QHTVTASVRL SYGEDLQMDW | 480 |
| | DGRGRLLVKL SPVYAGKTCG LCGNYNGNQG DDFLTPSGLA EPRVEDFGNA WKLHGDCQDL | 540 |
| | QKQHSDPCAL NPRMTRFSEE ACAVLTSPTF EACHRAVSPL PYLRNCRYDV CSCSDGRECL | 600 |
| | CGALASYAAA CAGRGVRVAW REPGRCELNC PKGQVYLQCG TPCNLTCRSL SYPDEECNEA | 660 |
| | CLEGCFCPPG LYMDERGDCV PKAQCPCYYD GEIFQPEDIF SDHHTMCYCE DGFMHCTMSG | 720 |
| | VPGSLLPDAV LSSPLSHRSK R | |
| VWF D' domain of chimeric polypeptide SEQ ID NO: 210 | SLSCRPPMVK LVCPADNLRA EGLECTKTCQ NYDLECMSMG CVSGCLCPPG MVRHENRCVA | 60 |
| | LERCPCFHQG KEYAPGETVK IGCNTCVCRD RKWNCTDHVC DAT | 103 |
| VWF D3 domain of chimeric polypeptide SEQ ID NO: 214 | CSTIGMAHYL TFDGLKYLFP GECQYVLVQD YCGSNPGTFR ILVGNKGCSH PSVKCKKRVT | 60 |
| | ILVEGGEIEL FDGEVNVKRP MKDETHFEVV ESGRYIILLL GKALSVVWDR HLSISVVLKQ | 120 |
| | TYQEKVCGLC GNFDGIQNND LTSSNLQVEE DPVDFGNSWK VSSQCADTRK VPLDSSPATC | 180 |
| | HNNIMKQTMV DSSCRILTSD VFQDCNKLVD PEPYLDVCIY DTCSCESIGD CAAFCDTIAA | 240 |
| | YAHVCAQHGK VVTWRTATLC PQSCEERNLR ENGYEAEWRY NSCAPACQVT CQHPEPLACP | 300 |
| | VQCVEGCHAH CPPGKILDEL LQTCVDPEDC PVCEVAGRRF ASGKKVTLNP SDPEHCQICH | 360 |
| | CDVVNLTCEA CQEP | 374 |
| Fc region SEQ ID NO: 217 | DKTHTCPPCP APELLGGPSV FLFPPKPKDT LMISRTPEVT CVVVDVSHED PEVKFNWYVD | 60 |
| | GVEVHNAKTK PREEQYNSTY RVVSVLTVLH QDWLNGKEYK CKVSNKALPA PIEKTISKAK | 120 |
| | GQPREPQVYT LPPSRDELTK NQVSLTCLVK GFYPSDIAVE WESNGQPENN YKTTPPVLDS | 180 |
| | DGSFFLYSKL TVDKSRWQQG NVFSCSVMHE ALHNHYTQKS LSLSPG | |

TABLE 19-continued

Additional chimeric polypeptide sequences

| Description/<br>SEQ ID NO. | Sequence | |
|---|---|---|
| XTEN AE288_3<br>SEQ ID NO: 218 | GTSESATPES GPGSEPATSG SETPGTSESA TPESGPGSEP ATSGSETPGT SESATPESGP | 60 |
| | GTSTEPSEGS APGSPAGSPT STEEGTSESA TPESGPGSEP ATSGSETPGT SESATPESGP | 120 |
| | GSPAGSPTST EEGSPAGSPT STEEGTSTEP SEGSAPGTSE SATPESGPGT SESATPESGP | 180 |
| | GTSESATPES GPGSEPATSG SETPGSEPAT SGSETPGSPA GSPTSTEEGT STEPSEGSAP | 240 |
| | GTSTEPSEGS APGSEPATSG SETPGTS- | |
| | ESA TPESGPGTST EPSEGSAPAS S | 291 |

The foregoing description of the specific embodiments will so fully reveal the general nature of the disclosure that others can, by applying knowledge within the skill of the art, readily modify and/or adapt for various applications such specific embodiments, without undue experimentation, without departing from the general concept of the present disclosure. Therefore, such adaptations and modifications are intended to be within the meaning and range of equivalents of the disclosed embodiments, based on the teaching and guidance presented herein. It is to be understood that the phraseology or terminology herein is for the purpose of description and not of limitation, such that the terminology or phraseology of the present specification is to be interpreted by the skilled artisan in light of the teachings and guidance.

Other embodiments of the disclosure will be apparent to those skilled in the art from consideration of the specification and practice of the disclosure disclosed herein. It is intended that the specification and examples be considered as exemplary only, with a true scope and spirit of the disclosure being indicated by the following claims.

All patents and publications cited herein are incorporated by reference herein in their entirety.

SEQUENCE LISTING (218 sequences)

SEQ ID NO: 1 - protein, 9 aa, Artificial Sequence
  Linker
TQSFNDFTR

SEQ ID NO: 2 - protein, 302 aa, Artificial Sequence
  pSYN FVIII 312A
PRSFSQNGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITR

SEQ ID NO: 3 - protein, 10 aa, Artificial Sequence
  Linker
SVSQTSKLTR

SEQ ID NO: 4 - protein, 10 aa, Artificial Sequence
  Linker
DFLAEGGGVR

SEQ ID NO: 5 - protein, 7 aa, Artificial Sequence
  Linker
TTKIKPR

SEQ ID NO: 6 - protein, 5 aa, Artificial Sequence
  Linker
LVPRG

SEQ ID NO: 7 - protein, 5 aa, Artificial Sequence
  Linker
ALRPR

SEQ ID NO: 8 - protein, 288 aa, Artificial Sequence
  XTEN AE288
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 9 - protein, 42 aa, Artificial Sequence
  XTEN AE42
GAPGSPAGSPTSTEEGTSESATPESGPGSEPATSGSETPASS

SEQ ID NO: 10 - protein, 78 aa, Artificial Sequence
  XTEN AE72
GAPTSESATPESGPGSEPATSGSETPGTSESATPESGPGSEPATSGSETPGTSESATPESGPGTSTEPSEGSAPGASS

SEQ ID NO: 11 - protein, 143 aa, Artificial Sequence
  XTEN AE144
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESAPESGPGSEPATSGSETPGTSTEPSEGSAP

SEQ ID NO: 12 - protein, 56 aa, Artificial Sequence
  pSYN VWF057
TSTEEGASSGGGGSGGGGSGGGGSGGGGSGGGGSGGGGSGGGGSLVPRGSGGDKTH

SEQ ID NO: 13 - protein, 46 aa, Artificial Sequence
  pSYN VWF059
TSTEEGASISDKNTGDYYEDSYEDISAYLLSKNNAIEPRSFSDKTH

SEQ ID NO: 14 - protein, 144 aa, Artificial Sequence
  XTEN AG144
GTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSP

SEQ ID NO: 15 - protein, 864 aa, Artificial Sequence
  XTEN AE864
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 16 - protein, 576 aa, Artificial Sequence
  XTEN AE576
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 17 - protein, 864 aa, Artificial Sequence
  XTEN AG864
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 18 - protein, 576 aa, Artificial Sequence
  XTEN AG576
PGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGS

SEQ ID NO: 19 - protein, 288 aa, Artificial Sequence
  XTEN AG288
PGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGS

SEQ ID NO: 20 - DNA, 8442 bp, Homo sapiens
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcrgagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgygtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagstgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtcttgctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 21 - protein, 2813 aa, Homo sapiens
  misc_feature (2016)..(2016): Xaa can be any naturally occurring amino acid
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVEXHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 22 - protein, 45 aa, Artificial Sequence
  pSYN VWF059A
TSTEEGASSDKNTGDYYEDSYEDISAYLLSKNNAIEPRSFSDKTH

SEQ ID NO: 23 - protein, 54 aa, Artificial Sequence
  pSYN VWF073
TSTEEGASSGGGGSGGGGSGGGGSGGGGSGGGGSGGGGSIEPRSFSGSGGDKTH

SEQ ID NO: 24 - protein, 12 aa, Artificial Sequence
  XTEN Motif Family AD
GESPGGSSGSES

SEQ ID NO: 25 - protein, 12 aa, Artificial Sequence
  XTEN Motif Family AD
GSEGSSGPGESS

SEQ ID NO: 26 - protein, 12 aa, Artificial Sequence
  XTEN Motif Family AD
GSSESGSSEGGP

SEQ ID NO: 27 - protein, 12 aa, Artificial Sequence
  XTEN Motif Family AD
GSGGEPSESGSS

SEQ ID NO: 28 - protein, 12 aa, Artificial Sequence
  XTEN Motif Families AE, AM
GSPAGSPTSTEE

SEQ ID NO: 29 - protein, 12 aa, Artificial Sequence
  XTEN Motif Families AE, AM, AQ
GSEPATSGSETP

SEQ ID NO: 30 - protein, 12 aa, Artificial Sequence
  XTEN Motif Families AE, AM, AQ
GTSESATPESGP

SEQ ID NO: 31 - protein, 12 aa, Artificial Sequence
  XTEN Motif Families AE, AM, AQ
GTSTEPSEGSAP

SEQ ID NO: 32 - protein, 12 aa, Artificial Sequence
  XTEN Motif Families AF, AM
GSTSESPSGTAP

SEQ ID NO: 33 - protein, 12 aa, Artificial Sequence
  XTEN Motif Families AF, AM
GTSTPESGSASP

SEQ ID NO: 34 - protein, 12 aa, Artificial Sequence
  AF, AM
GTSPSGESSTAP

SEQ ID NO: 35 - protein, 12 aa, Artificial Sequence
  XTEN Motif Families AF, AM
GSTSSTAESPGP

SEQ ID NO: 36 - protein, 12 aa, Artificial Sequence
  XTEN Motif Families AG, AM
GTPGSGTASSSP

SEQ ID NO: 37 - protein, 12 aa, Artificial Sequence
  XTEN Motif Families AG, AM
GSSTPSGATGSP

SEQ ID NO: 38 - protein, 12 aa, Artificial Sequence
  XTEN Motif Families AG, AM
GSSPSASTGTGP

SEQ ID NO: 39 - protein, 12 aa, Artificial Sequence
  XTEN Motif Families AG, AM
GASPGTSSTGSP

SEQ ID NO: 40 - protein, 12 aa, Artificial Sequence
  XTEN Motif Family AQ
GEPAGSPTSTSE

SEQ ID NO: 41 - protein, 12 aa, Artificial Sequence
  XTEN Motif Family AQ
GTGEPSSTPASE

SEQ ID NO: 42 - protein, 12 aa, Artificial Sequence
  XTEN Motif Family AQ
GSGPSTESAPTE

SEQ ID NO: 43 - protein, 12 aa, Artificial Sequence
  XTEN Motif Family AQ
GSETPSGPSETA

SEQ ID NO: 44 - protein, 12 aa, Artificial Sequence
  XTEN Motif Family AQ
GPSETSTSEPGA

SEQ ID NO: 45 - protein, 12 aa, Artificial Sequence
  XTEN Motif Family AQ
GSPSEPTEGTSA

SEQ ID NO: 46 - protein, 12 aa, Artificial Sequence
  XTEN Motif Family BC
GSGASEPTSTEP

SEQ ID NO: 47 - protein, 12 aa, Artificial Sequence
  XTEN Motif Family BC
GSEPATSGTEPS

SEQ ID NO: 48 - protein, 12 aa, Artificial Sequence
  XTEN Motif Family BC
GTSEPSTSEPGA

SEQ ID NO: 49 - protein, 12 aa, Artificial Sequence
  XTEN Family Motif BC
GTSTEPSEPGSA

SEQ ID NO: 50 - protein, 12 aa, Artificial Sequence
  XTEN Motif Family BD
GSTAGSETSTEA

SEQ ID NO: 51 - protein, 12 aa, Artificial Sequence
  XTEN Motif Family BD
GSETATSGSETA

SEQ ID NO: 52 - protein, 12 aa, Artificial Sequence
  XTEN Motif Family BD
GTSESATSESGA

SEQ ID NO: 53 - protein, 12 aa, Artificial Sequence
  XTEN Motif Family BD
GTSTEASEGSAS

SEQ ID NO: 54 - protein, 288 aa, Artificial Sequence
  XTEN AE288_2
GSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 55 - protein, 143 aa, Artificial Sequence
  XTEN AE144_2A
STEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 56 - protein, 144 aa, Artificial Sequence
  XTEN AE144_3B
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 57 - protein, 144 aa, Artificial Sequence
  XTEN AE144_4A
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 58 - protein, 144 aa, Artificial Sequence
  XTEN AE144_5A
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 59 - protein, 144 aa, Artificial Sequence
  XTEN AE144_6B
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 60 - protein, 144 aa, Artificial Sequence
  XTEN AG144_A
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSP

SEQ ID NO: 61 - protein, 144 aa, Artificial Sequence
  XTEN AG144_B
GTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSP

SEQ ID NO: 62 - protein, 144 aa, Artificial Sequence
  XTEN AG144_C
GTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSP

SEQ ID NO: 63 - protein, 144 aa, Artificial Sequence
  AG144_F
GSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 64 - protein, 19 aa, Artificial Sequence
  FVIII Signal Peptide
MQIELSTCFFLCLLRFCFS

SEQ ID NO: 65 - protein, 2332 aa, Artificial Sequence
  Mature Factor VIII
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 66 - DNA, 7053 bp, Artificial Sequence
  Full-Length FVIII
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctac

SEQ ID NO: 67 - protein, 1438 aa, Artificial Sequence
  BDD FVIII
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 68 - protein, 1429 aa, Artificial Sequence
  Amino Acid Sequence of B-domain Deleted Factor VIII (B-domain deletion except 5 amino acid residues
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 69 - protein, 2754 aa, Artificial Sequence
  pSYN-FVIII-161
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRRRRSGGGGSGGGGSGGGGSGGGGSGGGGSGGGGSRKRRKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPDSGGGGSGGGGSGGGGSGGGGSGGGGSLVPRGSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 1978 aa, Artificial Sequence
  FVIII 169
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 2242 aa, Artificial Sequence
  pSYN-FVIII-170
SLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPDSGGGGSGGGGSGGGGSGGGGSGGGGSLVPRGSGGASATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 72 - protein, 1959 aa, Artificial Sequence
  pSYN-FVIII-173
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 1984 aa, Artificial Sequence
  FVIII 195 (dual chain FVIIIFc with two 144 AE XTENs at amino acid 1656 and 1900)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 2134 aa, Artificial Sequence
  FVIII 196 (dual chain FVIIIFc with three 144 AE XTENs at amino acid 26, 1656 and 1900)
MQIELSTCFFLCLLRFCFSATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 1984 aa, Artificial Sequence
  FVIII 199 (single chain FVIIIFc with three 144 AE XTENs at amino acid 1656 and 1900)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 2134 aa, Artificial Sequence
  FVIII 201 (single chain FVIIIFc with three 144 AE XTENs at amino acid 26, 1656 &1900)
MQIELSTCFFLCLLRFCFSATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 2128 aa, Artificial Sequence
  FVIII 203 (single chain FVIIIFc with two AE XTENs, one 288AE XTEN in B-domain and one 144 AE XTEN at amino acid 1900)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 2128 aa, Artificial Sequence
  FVIII 204 (single chain FVIIIFc with two AE XTENs, one 288AE XTEN in B-domain and one 144 AE XTEN at amino acid 403)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 2128 aa, Artificial Sequence
  FVIII 205 (single chain FVIIIFc with two AE XTEN, one 288AE XTEN in B-domain and one 144 AE XTEN at amino acid 18)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 2020 aa, Artificial Sequence
  pSYN FVIII 266  (FVIII Fc with 42 AE-XTEN at amino acid 18 and 288 AE XTEN in B-domain)
MQIELSTCFFLCLLRFCFSATRRYYLGAVELSWDYMQGAPGSPAGSPTSTEEGTSESATPESGPGSEPATSGSETPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 2056 aa, Artificial Sequence
  pSYN FVIII 267 (FVIII Fc with 72 AE-XTEN at amino acid  18 and 288 AE XTEN in B-domain)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 1834 aa, Artificial Sequence
  pSYN FVIII 268 (FVIII Fc with 144 AE-XTEN at amino acid 18)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 1762 aa, Artificial Sequence
  pSYN FVIII 269 (FVIII Fc with 72 AE-XTEN at amino acid 18)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 1726 aa, Artificial Sequence
  pSYNFVIII  271 (FVIII Fc with 42 AE-XTEN at amino acid 18)
MQIELSTCFFLCLLRFCFSATRRYYLGAVELSWDYMQGAPGSPAGSPTSTEEGTSESATPESGPGSEPATSGSETPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 1901 aa, Artificial Sequence
  pSYN FVIII 272 ( FVIII with 144 AE XTEN at amino acid 18 and 244 AE XTEN in B-domain- no Fc)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 86 - protein, 1515 aa, Artificial Sequence
  VWF031
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGGGGSGGGGSGGGGSGGGGSGGGGSGGGGSLVPRGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 1778 aa, Artificial Sequence
  VWF034
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPDIGGGGGSGGGGSLVPRGSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 32 aa, Artificial Sequence
  Cleavable linker
DKNTGDYYEDSYEDISAYLLSKNNAIEPRSFS

SEQ ID NO: 89 - protein, 11 aa, Artificial Sequence
  Ig constant region portion
PKNSSMISNTP

SEQ ID NO: 90 - protein, 7 aa, Artificial Sequence
  Ig constant region portion
HQSLGTQ

SEQ ID NO: 91 - protein, 8 aa, Artificial Sequence
  Ig constant region portion
HQNLSDGK

SEQ ID NO: 92 - protein, 8 aa, Artificial Sequence
  Ig constant region portion
HQNISDGK

SEQ ID NO: 93 - protein, 8 aa, Artificial Sequence
  Ig constant region portion
VISSHLGQ

SEQ ID NO: 94 - protein, 5 aa, Artificial Sequence
  Linker, where the sequence can repeated between 1-20 times
GGGGS

SEQ ID NO: 95 - protein, 8 aa, Artificial Sequence
  Linker, where the sequence can be repeated between 1-100 times or 1-20 times
GGSGGGGS

SEQ ID NO: 96 - protein, 7 aa, Artificial Sequence
  Linker
SGGSGGS

SEQ ID NO: 97 - protein, 15 aa, Artificial Sequence
  Linker
GGSGGSGGSGGSGGG

SEQ ID NO: 98 - protein, 16 aa, Artificial Sequence
  Linker
GGSGGSGGGGSGGGGS

SEQ ID NO: 99 - protein, 18 aa, Artificial Sequence
  Linker
GGSGGSGGSGGSGGSGGS

SEQ ID NO: 100 - protein, 15 aa, Artificial Sequence
  Linker
GGGGSGGGGSGGGGS

SEQ ID NO: 101 - protein, 4 aa, Artificial Sequence
  Linker, where the sequence can be repeated between 1-00 times or 1-20 times
GGGS

SEQ ID NO: 102 - protein, 4 aa, Artificial Sequence
  Cleavage site
RRRR

SEQ ID NO: 103 - protein, 6 aa, Artificial Sequence
  Cleavage site
RKRRKR

SEQ ID NO: 104 - protein, 5 aa, Artificial Sequence
  Cleavage site
RRRRS

SEQ ID NO: 105 - protein, 4 aa, Artificial Sequence
  Thrombin cleavable site
  misc_feature (1)..(1): Xaa is an aliphatic amino acid
XVPR

SEQ ID NO: 106 - protein, 34 aa, Artificial Sequence
  Cleavable linker
ISDKNTGDYYEDSYEDISAYLLSKNNAIEPRSFS

SEQ ID NO: 107 - protein, 40 aa, Artificial Sequence
  Cleavable linker
ISMKNNEEAEDYDDDLTDSEMDVVRFDDDNSPSFIQIRSV

SEQ ID NO: 108 - protein, 46 aa, Artificial Sequence
  Cleavable linker
ISEITRTTLQSDQEEIDYDDTISVEMKKEDFDIYDEDENQSPRSFQ

SEQ ID NO: 109 - protein, 6 aa, Artificial Sequence
  PAR1 exosite interaction motif
SFLLRN

SEQ ID NO: 110 - protein, 4 aa, Artificial Sequence
  PAR1 exosite interaction motif
PNDK

SEQ ID NO: 111 - protein, 5 aa, Artificial Sequence
  PAR1 exosite interaction motif
PNDKY

SEQ ID NO: 112 - protein, 6 aa, Artificial Sequence
  PAR1 exosite interaction motif
PNDKYE

SEQ ID NO: 113 - protein, 7 aa, Artificial Sequence
  PAR1 exosite interaction motif
PNDKYEP

SEQ ID NO: 114 - protein, 8 aa, Artificial Sequence
  PAR1 exosite interaction motif
PNDKYEPF

SEQ ID NO: 115 - protein, 9 aa, Artificial Sequence
  PAR1 exosite interaction motif
PNDKYEPFW

SEQ ID NO: 116 - protein, 10 aa, Artificial Sequence
  PAR1 exosite interaction motif
PNDKYEPFWE

SEQ ID NO: 117 - protein, 11 aa, Artificial Sequence
  PAR1 exosite interaction motif
PNDKYEPFWED

SEQ ID NO: 118 - protein, 12 aa, Artificial Sequence
  PAR1 exosite interaction motif
PNDKYEPFWEDE

SEQ ID NO: 119 - protein, 13 aa, Artificial Sequence
  PAR1 exosite interaction motif
PNDKYEPFWEDEE

SEQ ID NO: 120 - protein, 14 aa, Artificial Sequence
  PAR1 exosite interaction motif
PNDKYEPFWEDEES

SEQ ID NO: 121 - protein, 7 aa, Artificial Sequence
  FXIa cleavage site
KLTRAET

SEQ ID NO: 122 - protein, 7 aa, Artificial Sequence
  FXIa cleavage site
DFTRVVG

SEQ ID NO: 123 - protein, 8 aa, Artificial Sequence
  FXIIa cleavage site
TMTRIVGG

SEQ ID NO: 124 - protein, 8 aa, Artificial Sequence
  Kallikrein cleavage site
SPFRSTGG

SEQ ID NO: 125 - protein, 8 aa, Artificial Sequence
  FVIIa cleavage site
LQVRIVGG

SEQ ID NO: 126 - protein, 8 aa, Artificial Sequence
  FIXa cleavage site
PLGRIVGG

SEQ ID NO: 127 - protein, 8 aa, Artificial Sequence
  FXa cleavage site
IEGRTVGG

SEQ ID NO: 128 - protein, 8 aa, Artificial Sequence
  FIIa (thrombin) cleavage site
LTPRSLLV

SEQ ID NO: 129 - protein, 8 aa, Artificial Sequence
  Elastase-2 cleavage site
LGPVSGVP

SEQ ID NO: 130 - protein, 8 aa, Artificial Sequence
  Granzyme-B cleavage
VAGDSLEE

SEQ ID NO: 131 - protein, 8 aa, Artificial Sequence
  MMP-12 cleavage site
GPAGLGGA

SEQ ID NO: 132 - protein, 8 aa, Artificial Sequence
  MMP-13 cleavage site
GPAGLRGA

SEQ ID NO: 133 - protein, 8 aa, Artificial Sequence
  MMP-17 cleavage site
APLGLRLR

SEQ ID NO: 134 - protein, 8 aa, Artificial Sequence
  MMP-20 cleavage site
PALPLVAQ

SEQ ID NO: 135 - protein, 7 aa, Artificial Sequence
  TEV cleavage site
ENLYFQG

SEQ ID NO: 136 - protein, 8 aa, Artificial Sequence
  Enterokinase cleavage site
DDDKIVGG

SEQ ID NO: 137 - protein, 8 aa, Artificial Sequence
  Protease 3C (PRESCISSION) cleavage site
LEVLFQGP

SEQ ID NO: 138 - protein, 8 aa, Artificial Sequence
  Sortase A cleavage site
LPKTGSES

SEQ ID NO: 139 - protein, 31 aa, Artificial Sequence
  Cleavable linker
KNTGDYYEDSYEDISAYLLSKNNAIEPRSFS

SEQ ID NO: 140 - protein, 30 aa, Artificial Sequence
  Cleavable linker
NTGDYYEDSYEDISAYLLSKNNAIEPRSFS

SEQ ID NO: 141 - protein, 29 aa, Artificial Sequence
  Cleavable linker
TGDYYEDSYEDISAYLLSKNNAIEPRSFS

SEQ ID NO: 142 - protein, 28 aa, Artificial Sequence
  Cleavable linker
GDYYEDSYEDISAYLLSKNNAIEPRSFS

SEQ ID NO: 143 - protein, 27 aa, Artificial Sequence
  Cleavable linker
DYYEDSYEDISAYLLSKNNAIEPRSFS

SEQ ID NO: 144 - protein, 26 aa, Artificial Sequence
  Cleavable linker
YYEDSYEDISAYLLSKNNAIEPRSFS

SEQ ID NO: 145 - protein, 10 aa, Artificial Sequence
  Thrombin cleavage site
ALRPRVVGGA

SEQ ID NO: 146 - protein, 25 aa, Artificial Sequence
  Linker
TLDPRSFLLRNPNDKYEPFWEDEEK

SEQ ID NO: 147 - DNA, 4548 bp, Artificial Sequence
  VWF031
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatctggcggtggaggttccggtggcgggggatccggcggtggaggttccggcggtggaggttccggtggcgggggatccggtggcgggggatccctggtcccccggggcagcggcggtggaggttccggtggcgggggatccgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 148 - DNA, 5379 bp, Artificial Sequence
  VWF034
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatcgggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagattctggcggtggaggttccggtggcgggggatccggtggcgggggatccggtggcgggggatccggtggcgggggatccctggtcccccggggcagcggaggcgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 149 - DNA, 4548 bp, Artificial Sequence
  VWF050 (IHH triple mutant)
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatctggcggtggaggttccggtggcgggggatccggcggtggaggttccggcggtggaggttccggtggcgggggatccggtggcgggggatccctggtcccccggggcagcggcggtggaggttccggtggcgggggatccgacaaaactcacacatgcccaccgtgcccagctccagaactcctgggcggaccgtcagtcttcctcttccccccaaaacccaaggacaccctcatggcctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctggcccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaacgcctacacgcagaagagcctctccctgtctccgggtaaatga

SEQ ID NO: 150 - protein, 1515 aa, Artificial Sequence
  VWF050 (IHH triple mutant)
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGGGGSGGGGSGGGGSGGGGSGGGGSGGGGSLVPRGSGGGGSGGGGSDKTHTCPPCPAPELLGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 151 - DNA, 4959 bp, Artificial Sequence
  VWF057
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatcgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcggcggtggaggttccggtggcgggggatccggtggcgggggatccggtggcgggggatccggtggcgggggatccctggtcccccggggcagcggaggcgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 152 - protein, 1652 aa, Artificial Sequence
  VWF057
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSGGGGSGGGGSGGGGSGGGGSGGGGSLVPRGSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 153 - DNA, 5379 bp, Artificial Sequence
  VWF058 (VWF034 with IHH mutation)
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatcgggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagattctggcggtggaggttccggtggcgggggatccggtggcgggggatccggtggcgggggatccggtggcgggggatccctggtcccccggggcagcggaggcgacaaaactcacacatgcccaccgtgcccagctccagaactcctgggcggaccgtcagtcttcctcttccccccaaaacccaaggacaccctcatggcctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctggcccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaacgcctacacgcagaagagcctctccctgtctccgggtaaatga

SEQ ID NO: 154 - protein, 1792 aa, Artificial Sequence
  VWF058 (VWF034 with IHH mutation)
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPDSGGGGSGGGGSGGGGSGGGGSGGGGSLVPRGSGGDKTHTCPPCPAPELLGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 155 - DNA, 5937 bp, Artificial Sequence
  FVIII 169
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 156 - DNA, 6387 bp, Artificial Sequence
  FVIII 263 (IHH triple mutant)
atgcaaatagagctctccacctgcttctttctgtgccttttgcgattctgctttagtgccaccagaagatactacctgggtgcagtggaactgtcatgggactatatgcaaggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatggcctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctggcccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaacgcctacacgcagaagagcctctccctgtctccgggtaaatga

SEQ ID NO: 157 - protein, 2128 aa, Artificial Sequence
  FVIII 263 (IHH triple mutant)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 158 - DNA, 5505 bp, Artificial Sequence
  FVIII 282
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 159 - protein, 1834 aa, Artificial Sequence
  FVIII 282
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - DNA, 5937 bp, Artificial Sequence
  FVIII 283 (FVIII 169 with IHH triple mutation)
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatggcctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctggcccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaacgcctacacgcagaagagcctctccctgtctccgggtaaatga

SEQ ID NO: 161 - protein, 1978 aa, Artificial Sequence
  FVIII 283 (FVIII 169 with IHH triple mutation)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 162 - DNA, 5055 bp, Artificial Sequence
  pSYNFVIII 010 (Dual chain FVIIIFc)
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 163 - protein, 1684 aa, Artificial Sequence
  pSYNFVIII 010 (Dual chain FVIIIFc)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 6 aa, Artificial Sequence
  Linker, where the sequence can be repeated betweeen 1-10 times
SGGGGS

SEQ ID NO: 165 - protein, 20 aa, Artificial Sequence
  Linker
GGGGSGGGGSGGGGSGGGGS

SEQ ID NO: 166 - protein, 34 aa, Artificial Sequence
  Linker
SGGGGSGGGGSGGGGSGGGGSGGGGSLVPRGSGG

SEQ ID NO: 167 - protein, 314 aa, Artificial Sequence
  pSYN FVIII 169
PRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITR

SEQ ID NO: 168 - protein, 302 aa, Artificial Sequence
  pSYN FVIII 310
PRSFGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITR

SEQ ID NO: 169 - protein, 305 aa, Artificial Sequence
  pSYN FVIII 312
PRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITR

SEQ ID NO: 170 - DNA, 5892 bp, Artificial Sequence
  pSYN FVIII 310 (encoding FVIII with complete B-domain deletion except 2 amino acid residues and 288 AE-XTEN inserted after aa 742)
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttcggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 171 - protein, 1944 aa, Artificial Sequence
  pSYN FVIII 310 (FVIII with complete B-domain deletion except 2 amino acid residues and 288 AE-XTEN inserted after aa 742)
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 172 - DNA, 5900 bp, Artificial Sequence
  pSYN FVIII 312 (FVIII with complete B-domain deletion except 5 amino acid residues and 288 AE-XTEN inserted after aa 745- FVIII B5 version)
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatg

SEQ ID NO: 173 - protein, 1947 aa, Artificial Sequence
  pSYN FVIII 312 (FVIII with complete B-domain deletion except 5 amino acid residues and 288 AE-XTEN inserted after aa 745- FVIII B5 version)
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - DNA, 4977 bp, Artificial Sequence
  pSYN VWF073 (VWFD1D2D'D3- 144 AE XTEN- FVIII truncated a2 thrombin site-Fc)
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcggcggtggaggatccggtggcgggggatccggtggcgggggatccggtggcgggggatccggtggcgggggatccggtggcgggggatccattgaaccaagaagcttctctggcagcggaggcgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 175 - protein, 1658 aa, Artificial Sequence
  pSYN VWF073 (VWFD1D2D'D3- 144 AE XTEN- truncated a2 thrombin site-Fc)
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSGGGGSGGGGSGGGGSGGGGSGGGGSGGGGSIEPRSFSGSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 176 - protein, 25 aa, Artificial Sequence
  Cleavable linker
YEDSYEDISAYLLSKNNAIEPRSFS

SEQ ID NO: 177 - protein, 24 aa, Artificial Sequence
  Cleavable linker
EDSYEDISAYLLSKNNAIEPRSFS

SEQ ID NO: 178 - protein, 23 aa, Artificial Sequence
  Cleavable linker
DSYEDISAYLLSKNNAIEPRSFS

SEQ ID NO: 179 - protein, 22 aa, Artificial Sequence
  Cleavable linker
SYEDISAYLLSKNNAIEPRSFS

SEQ ID NO: 180 - protein, 21 aa, Artificial Sequence
  Cleavable linker
YEDISAYLLSKNNAIEPRSFS

SEQ ID NO: 181 - protein, 20 aa, Artificial Sequence
  Cleavable linker
EDISAYLLSKNNAIEPRSFS

SEQ ID NO: 182 - protein, 19 aa, Artificial Sequence
  Cleavable linker
DISAYLLSKNNAIEPRSFS

SEQ ID NO: 183 - protein, 18 aa, Artificial Sequence
  Cleavable linker
ISAYLLSKNNAIEPRSFS

SEQ ID NO: 184 - protein, 17 aa, Artificial Sequence
  Cleavable linker
SAYLLSKNNAIEPRSFS

SEQ ID NO: 185 - protein, 16 aa, Artificial Sequence
  Cleavable linker
AYLLSKNNAIEPRSFS

SEQ ID NO: 186 - protein, 15 aa, Artificial Sequence
  Cleavable linker
YLLSKNNAIEPRSFS

SEQ ID NO: 187 - protein, 14 aa, Artificial Sequence
  Cleavable linker
LLSKNNAIEPRSFS

SEQ ID NO: 188 - protein, 13 aa, Artificial Sequence
  Cleavable linker
LSKNNAIEPRSFS

SEQ ID NO: 189 - protein, 12 aa, Artificial Sequence
  Cleavable linker
SKNNAIEPRSFS

SEQ ID NO: 190 - protein, 11 aa, Artificial Sequence
  Cleavable linker
KNNAIEPRSFS

SEQ ID NO: 191 - protein, 10 aa, Artificial Sequence
  Cleavable linker
NNAIEPRSFS

SEQ ID NO: 192 - protein, 9 aa, Artificial Sequence
  Cleavable linker
NAIEPRSFS

SEQ ID NO: 193 - protein, 8 aa, Artificial Sequence
  Cleavable linker
AIEPRSFS

SEQ ID NO: 194 - protein, 7 aa, Artificial Sequence
  Cleavable linker
IEPRSFS

SEQ ID NO: 195 - protein, 6 aa, Artificial Sequence
  Cleavable linker
EPRSFS

SEQ ID NO: 196 - DNA, 4959 bp, Artificial Sequence
  pSYN VWF059 (VWF D'D3-Fc with acidic region 2 (a2) thrombin site in the linker)
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatcgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgatatctgacaagaacactggtgattattacgaggacagttatgaagatatttcagcatacttgctgagtaaaaacaatgccattgaaccaagaagcttctctgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 197 - protein, 1652 aa, Artificial Sequence
  pSYN VWF059 (VWF D'D3-Fc with LVPR thrombin site in the linker)
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASISDKNTGDYYEDSYEDISAYLLSKNNAIEPRSFSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - DNA, 4860 bp, Artificial Sequence
  pSYN VWF062 (VWF D'D3-Fc with no thrombin site in the linker)
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatcgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 199 - protein, 1619 aa, Artificial Sequence
  pSYN VWF062 (VWF D'D3-Fc with no thrombin site in the linker)
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 4 aa, Artificial Sequence
  Cleavable linker
IEPR

SEQ ID NO: 201 - protein, 1945 aa, Artificial Sequence
  FVIII(XTEN)-Fc
TRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 202 - protein, 883 aa, Artificial Sequence
  VWF(D'D3)-XTEN-a2 Linker-Fc
SLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDKNTGDYYEDSYEDISAYLLSKNNAIEPRSFSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 203 - protein, 1965 aa, Artificial Sequence
  Final amino acid sequence of FVIII 312A
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 204 - DNA, 5898 bp, Artificial Sequence
  Final nucleotide sequence of FVIII 312A  (SEQ ID NO: 204)
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggaacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaagtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaagttagcctgacctgcctggtcaaaggcttctatcccagcgacatcgccgtggagtgggagagcaatgggcagccggagaacaactacaagaccacgcctcccgtgttggactccgacggctccttcttcctctactccaagctcaccgtggacaagagcaggtggcagcaggggaacgtcttctcatgctccgtgatgcatgaggctctgcacaaccactacacgcagaagagcctctccctgtctccgggttga

SEQ ID NO: 205 - protein, 1646 aa, Artificial Sequence
  Final amino acid sequence of VWF059A polypeptide
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDKNTGDYYEDSYEDISAYLLSKNNAIEPRSFSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 206 - DNA, 4941 bp, Artificial Sequence
  Final nucleotide sequence of VWF059A
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggtacatcagagagcgccacccctgaaagtggtcccgggagcgagccagccacatctgggtcggaaacgccaggcacatccgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgtctgacaagaacactggtgattattacgaggacagttatgaagatatttcagcatacttgctgagtaaaaacaatgccattgaaccaagaagcttctctgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaagtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaagttagcctgacctgcctggtcaaaggcttctatcccagcgacatcgccgtggagtgggagagcaatgggcagccggagaacaactacaagaccacgcctcccgtgttggactccgacggctccttcttcctctactccaagctcaccgtggacaagagcaggtggcagcaggggaacgtcttctcatgctccgtgatgcatgaggctctgcacaaccactacacgcagaagagcctctccctgtctccgggttga

SEQ ID NO: 207 - protein, 1946 aa, Artificial Sequence
  FVIII(XTEN)-Fc w lead A
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 208 - protein, 22 aa, Homo sapiens
MIPARFAGVLLALALILPGTLC

SEQ ID NO: 209 - protein, 741 aa, Homo sapiens
AEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKR

SEQ ID NO: 210 - protein, 103 aa, Homo sapiens
SLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDAT

SEQ ID NO: 211 - protein, 374 aa, Homo sapiens
CSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEP

SEQ ID NO: 212 - protein, 239 aa, Homo sapiens
GGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVG

SEQ ID NO: 213 - protein, 1334 aa, Homo sapiens
  misc_feature (537)..(537): Xaa can be any naturally occurring amino acid
PGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVEXHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 214 - protein, 374 aa, Artificial Sequence
  VWF D3 region EAE
CSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEP

SEQ ID NO: 215 - protein, 745 aa, Artificial Sequence
  1 to 745 of FVIII
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQN

SEQ ID NO: 216 - protein, 684 aa, Artificial Sequence
  FVIII 1649-2332
EITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 217 - protein, 226 aa, Artificial Sequence
  Fc region
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 218 - protein, 291 aa, Artificial Sequence
  XTEN AE288-3
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASS

What is claimed is:

1. A method of treating hemophilia A comprising administering multiple doses of a chimeric polypeptide at a dosing interval to a human subject in need thereof, wherein the chimeric polypeptide comprises:
   (i) a FVIII protein comprising the amino acid sequence of SEQ ID NO: 207; and
   (ii) a VWF protein comprising the amino acid sequence of SEQ ID NO: 202;
   wherein each of the multiple doses is from 45 IU/kg to 55 IU/kg and the dosing interval is at least 6 days to 8 days; and
   wherein the multiple doses are administered for at least about 6 months;
   wherein the chimeric polypeptide is administered for prophylactic treatment;
   wherein the subject has less than 1 IU/dL endogenous FVIII;
   wherein the subject is at least 12 years of age;
   wherein the FVIII protein is covalently linked to the VWF protein by a disulfide bond, and
   wherein the chimeric polypeptide is administered intravenously.

2. A method of treating hemophilia A comprising administering multiple doses of a chimeric polypeptide at a dosing interval to a human subject in need thereof, wherein the chimeric polypeptide comprises:
   (i) a FVIII protein comprising:
      (a) a first FVIII polypeptide fragment comprising the amino acid sequence of SEQ ID NO: 215;
      (b) a first XTEN sequence comprising the amino acid sequence of SEQ ID NO: 8;
      (c) a second FVIII polypeptide fragment comprising the amino acid sequence of SEQ ID NO: 216; and
      (d) a first Fc region comprising the amino acid sequence of SEQ ID NO: 217;
   (ii) a VWF protein comprising:
      (a) a D' domain of VWF comprising the amino acid sequence of SEQ ID NO: 210;
      (b) a D3 domain of VWF comprising the amino acid sequence of SEQ ID NO: 214;
      (c) a second XTEN sequence comprising the amino acid sequence of SEQ ID NO: 584;
      (d) an a2 linker comprising the amino acid sequence of SEQ ID NO: 88; and
      (e) a second Fc region comprising the amino acid sequence of SEQ ID NO: 217;
      wherein each of the multiple doses is from 45 IU/kg to 55 IU/kg and the dosing interval is at least 6 days to 8 days; and
      wherein the multiple doses are administered for at least about 6 months;
      wherein the chimeric polypeptide is administered for prophylactic treatment;
      wherein the subject has less than 1 IU/dL endogenous FVIII;

wherein the subject is at least 12 years of age; and
wherein the first Fc region is covalently linked to the second Fc region by a disulfide bond.

3. The method of claim 1, wherein each of the multiple doses is 50 IU/kg and the dosing interval is 7 days.

4. The method of claim 1, wherein the subject has previously received treatment for hemophilia A with any recombinant FVIII, plasma-derived FVIII, or cryoprecipitate for at least 150 exposure days (ED).

5. The method of claim 1, wherein the subject was either (a) previously on a prophylactic treatment regimen with a marketed FVIII product and has had at least four bleeding episodes in the twelve months prior to administration of the chimeric polypeptide; or (b) previously on an on-demand treatment regimen with a marketed FVIII product and has had at least twelve bleeding episodes in the twelve months prior to administration of the chimeric polypeptide.

6. The method of claim 1, wherein the subject has a platelet count of at least 100,000 cells/μL.

7. The method of claim 1, wherein the subject is free of other coagulation disorders in addition to hemophilia A.

8. The method of claim 1, wherein the subject does not have a history of developing inhibitors to a FVIII product.

9. The method of claim 1, wherein the FVIII protein is covalently linked to the VWF protein by two disulfide bonds.

10. The method of claim 2, wherein the FVIII protein is covalently linked to the VWF protein by two disulfide bonds.

11. A method of prophylactically treating severe hemophilia A comprising administering to a human subject in need thereof a chimeric polypeptide comprising (i) a FVIII protein comprising the amino acid sequence set forth in SEQ ID NO: 207; and
(ii) a VWF protein comprising a D' domain of VWF and a D3 domain of VWF comprising the amino acid sequence set forth in SEQ ID NO: 202;
wherein the chimeric polypeptide is administered intravenously as a once weekly dose of 50 IU/kg for at least about 6 months.

12. The method of claim 11, wherein the subject has had at least 150 exposure days (ED) to FVIII products.

13. The method of claim 11, wherein the subject has no history of positive inhibitor tests or clinical signs of decreased response to FVIII administration.

14. The method of claim 1, wherein the multiple doses are administered for at least about 9 months.

15. The method of claim 1, wherein the multiple doses are administered for at least about 12 months.

16. The method of claim 11, wherein the chimeric polypeptide is administered for at least about 9 months.

17. The method of claim 11, wherein the chimeric polypeptide is administered for at least about 12 months.

18. The method of claim 1, wherein administration of the chimeric polypeptide results in a FVIII plasma activity level of at least about 9 IU/dL in the subject for a week or longer, wherein the FVIII plasma activity level is assessed by an activated partial thromboplastin time (aPTT) assay.

19. The method of claim 11, wherein administration of the chimeric polypeptide results in a FVIII plasma activity level of at least about 9 IU/dL in the subject for a week or longer, wherein the FVIII plasma activity level is assessed by an aPTT assay.

* * * * *